United States Patent 12,642,819 (COMPOSITIONS AND METHODS FOR TREATING INFLAMMATORY BOWEL DISEASE) - sequence listing, part 21

SEQ ID NO: 8 - DNA, 7031789 bp, Bacteroides ovatus (residues 3,515,897-5,273,844 of 7,031,789)
  modified_base (543563)..(543660): a, c, t, g, unknown or other
  modified_base (834166)..(834263): a, c, t, g, unknown or other
  modified_base (1359427)..(1359525): a, c, t, g, unknown or other
  modified_base (1363435)..(1363532): a, c, t, g, unknown or other
  modified_base (2397659)..(2397758): a, c, t, g, unknown or other
  modified_base (3524830)..(3524926): a, c, t, g, unknown or other
  modified_base (5335779)..(5335878): a, c, t, g, unknown or other
  modified_base (5544389)..(5544487): a, c, t, g, unknown or other
  modified_base (6985132)..(6985257): a, c, t, g, unknown or other
  modified_base (6990750)..(6991288): a, c, t, g, unknown or other
ctgttgaatccaaaatattggcaaggtcaatgctggaattggaaaccccttattatttgcaattgtttaaaaatgaatttattacagcgaaaaaggtcctgaatccggattttgaaataaatgatgaacctagcattagaatagacaatgatatagtatctctttctgattgtaaagttggtgagaatgtatcttttgtgattcccatttataatgacggaaaatatcctttaaagatctcgaagatttttacaagttgttcttgtttgagtctaatagaccatacgaaggagtttgttgtttctccgaaggattctgtaatggttagatttaactttagatcagaagaatcaggagaagtcactagggacgtttttataacttccaattcgataaatagacctattctatatgtgaaaatattggctgatatatattgattattaatttaaaaacaaaaatgatgagaaaattattatttgtcgtaattggtgttacttttcttgtacaaggttgttcgctgaatgatggttttatagacgaacaaatagcttctgaaaaagagattgtgagagaagatattgattttccaaaacaggttgaggctttcgggaaaggagtggccaaagaaattgaagttacagtaggaaaattgaatgatctgaatgtggactattcggaaattgcaggctctaagaattttcgtgagaagttttatgatgattggtataatgcgaaccctacaatagccaaaagccgtactgtaggaacaactcacccgcttgatatgatgagtgcaattgaactaatagaaagatacaattctttgacaaataagcagttggattttattcgagaaatcattagtgaatgcaaaaaaagtaaatccgatcaagatttattggataggttgatagacttgaatgaagaaattcattcgcaagttccggaaatagaacaagaaagattgttgaatattattgcagttctatattatggactacaaaaagtgtcttatcttgaaaaccaaggtctgatgttgaagactccatataatagtattaaaattacaaaggttaaaacgagatcgggcgatgtgaatgtaggaagtatattgggatattgtcgcgatttgactggaacagtttggggaattgctcttgctgaaccgacgccatacggtgaagttggagctactattggaaccgctttaatttatattggagccgctgctacaataatatatgaagtagtttcatgtgatgaatatgaagagggagggaccataacgggtactaacactcagtataatataggtgaatgtatagaattttatgatcaatgtcaacgaatgggtgggtggcagtcgactatatggaatggttcttcagaatgcaaacattgcttagacgattgtaggtcaaatggaacatggaattgtcaaggaaattaactaatgttgtatatgaaaggctttaaaattattattaatgaagcagaagttgtacttgctgcaattcctgacggaattctcaatttcattcttgcattagataattctggtgtgctattgtttgtaggcggaatcgatcctgcgacagaatcgcatgtctattggtattatgaccgttgtctcaacgtcaatgataacctgactctacaaatagaggattttgatcagtgttctcctattgtacatatcaaaccaagaagtaaagcttcgcttatggcagaatacaatacacttaaagaacaacttagtaaacaaggattaatatgaaagggatactattaaaatataatgattacacctataaaataagtgttgcttctgctgcctccattgtggttggcctaaatggaataagaaactttgaatgtcatttacaagcaggtgctttcgacccgcaaagaaacagcttcattcagtgggtaggagaatttgtaccattggatgttaaattgtccataacggttggtaatatagatgccgtttcggaacctattagagtggatgaacgcacggaagatcgttgctgtgtcgctgatgataagattaatgattccgaggactgggaaaataagttacgccgtttcagacatcttgaagccattttaaaagagaaatagattatgataggatttaaaatatatattaatgatgagaaacctataataatggcttcagatagcattatatctgtgatacttaggtatggttatccttcggaggccattattagtttgattgggagggattgttctaacgatcttacttggcttaaaggtaagccggagattggtgataagataataataaaagtcgttgagacagatgaggtatcgccatgtaaaaaaacgaaaagtgacagggaacggatgatacgacagtatgaacgactcaaagttaaacttcaagagaaaggacttatataggatgaaggggcttattgtaaaatacaaagataaggtatgtaaggctagtgttcctctcggtggagcacttcttactgctgatgttacttggcatagtggtgcatattggagcgttggaggtttgaaaatgcctgaagaggtacactttatatggaatagtggtatgttagaggtaggagatgtaatagaagtggaagttgcagaatttgatgaagcctcaatgcctgttgcagatgaaaagcacagttctttgatgaaaaagatgtcggagagggtagaggattattcaaaagatttggaattttactaccggttgaaaaaggtattggaggatgagaacttgatttaatactaagataaaaatgataagactctttcatattttgtttgccgcagcatgtataggcagtatgtttgtatattcccaccaatttacagacgcatatattgtgcctaaatggtgctgcgttttgtttgtgctgttatggatgctggtgtatgctgcatttctggcattgcagcgtaaatccatagtggcggatatggcgatatgggggagtattatagttttcagttgttggttgcaggctgtttatggaatattgcaatacgtaggtttattttcttctcatgtaacttttcgtgtgaccggtagttttgataatccggcaggatttgcagcttgcctttgtgccggattgccttttgtcgtttttttgatcatacatagaaataagtacattcgatatgccggatggattgcagggggagtgatggtgttggcgatatttttatctcattcgcgatccggtatggtaagtgtcattgcggtatgtgtcatgtatttgtgtggaagattcgttcatgggagattgtggagatatttattatcggtatctatgataggattgttaataatcggctcctattggttgaaaaaagattcggcagatggtcggttgttgatttggcggtgtggcttggaaatggtgaaagatgctccttggacggggcatggcatcggaagtttcgaggctaaatatatggactatcaggcggactacttcaaagaatatggttcgcaaaatcgctatgcaatgttagcggataatgtaaagcagccttttaatgaatatttgggagttctgattaatttcggtattgtcggattggctttgcttttgggtattgtgggggcgcttgtgtattgttataggcaaaatcctacacaggaaaagaaaatagctctttatgctttgctatcaataggcgtattctctttcttttcctatccgtttacgtatcctttcacgtggatggtgacatctcttgccgttctcatgttgactgctgattatttgaagcggataaagataggtacatggggcaggaatataatgtattccgcagtgttgatgggcttctttttgggacaggttaggctgggcgcacgtacacagtcggaacgcagttggcaggaggcttcagtgttagctctttgtcattcgtatgatgaggctcttccgtactatgtaagtctgaaacaccgattcgaagataatccttatttcttgtataattatgctgctgttttcacggaagccaaagaatacgagaaggctttgaaggtagcattggagtgtcgcaagtattgggcagattatgatcttgaattattattgggtgatatctatagagaaaaaaaggattataaacaggctgaagaatactatatgagtgcttcgtatatgtgccctagtcgttttttgcctctttatcaattgtatgaactgtataaatgcataggtaacacagagaaggcttcggaattggcaaagatacttttggaaaagcctgcaaaagtaaattcggcgttgataaagagaatacgatatatggtgaaaaaagatggtttaattaatagtgtacgaagatgaaaaagaattataagatcatacttcttttctgcttattgctaggcggaatgctctctgatgcttctgcaaagagaaaaaactccttcgtaagaaaggatgaaatattttcttattattcgaagtttgtttccgaggtttgggacatctcgtggaagaaaccgaaaggctttacggatttgatgaagagcgagacgtgggcgttcggcaagaaagacccttattctttattttatcggctgaccgttgagtcagtcgataaggattgtctcatcatgtatcccgaactgaagatggtgacgcctttccctgatattgcatggacggaaaaatgtggaaaaccggaatttctgagaaattatgttatgatggaggtcggtgattctttgattgaagaacgactgacggtgttttccggaactgaggctccgatgaatgcagatacggtgttcgtgttccgcactgcattgaagaacgtttataaaggatattcatattgtacaagcatctatgcctacaaggaaggtcgaccgcctatgatattccgttgcttctttacagaaaagggaaaggcaaaagaaaagcgatatctttcaaagttctgcaagtcggtcaactacggaaacaacaaggaatggaaaatggatgctgataaaatgcgtgaggcttcttcccggatattctattcgtttacgaacgcagagcggaaggggctttttagtgagtatcaggtggagtgtgaacgagactttcatataaaattgagtatgccggcaggatttgagactattgataaaatggtctcattcagagtaaatgaaggaagaaacattggtgtattttatagtttgttgttggaatcaagagataaggactgcctgatgctatatccgctttttattgaaaatcaatctcatggcattgctaaaaatatgacttatggtgaagtaaaggctgcattgaatttagcaccggaagagaatgaatgtatgagaatgaatttggtgaatggcaagtttacgcttggtaagagtaaagtacccgaccgttcaaaggaaacggtacagttcgacactgcccgctatatgagagtgatcgcagaggagaatatggagaattattgcaatgccgatacggtatatgtgtatgaagttccgttattgaaaccttataaaggagtttatacgaagtgtatcgggataaatatggtgaaagaggggcatccgtatggaatggcaaaaatccttctgatggaaggagacaatgcgaaagataaatacatgaaacagtttctcgaaagtatacgttacagtgatagtatattgggagaaaatagtgaaaaagcttgcaaagataaattcaatgttaatcaagcggataaaatatcaactcaaaaaggagtgtgaacctttaatattatgaatatagtatgtaattatgcggcattcataatgtttttccttaatgtatacctttatatttggaatcctttggggaaacattatgatttaattaaaatagtgtttggttgggtaattgctttgtttgtatttaattatttgtttcggcatagcaaaatagaaaggataggatatgttatatctataacgcttcttgccttagcttattttgtgattccaacataggctctgtttggttataatagttctccttatggttcgtttaaggtgctttagttactatatgtcgagatattttctatcaagaatgagaagaattgagcagatatgtatctctctgtatccatagcagtcgttattaactgcaaaactgtaaattgaaagttagttaggactaagtgcctgacaatatattatttgtaataaaaaacaattatgagaaagtatatcctttatttgttagctatcctgttggcagcctgttcgaaaagtgttccttattctgacgaaactattaaaaacgacttgcgtgtacctgcttatccgctactgatgctccacccacatctgcgtttatggtcgacaacagatcagctgacagagaagaatatgatttttactaatgggaaaaatcttccttttgtcggtttcctgcgggtggacggaacgatgtatcgctttatgggtagacgtgaactacctatgcaagccattgcaacaatggcatacgattatgaaagctgggaaggaaagtacacctctcttagaccggatgaaggctgggagcaaccggattttaatgatcaatattggcaggtaaatgaaggtgcattcggtacacgcgacagacgtgaaacgagaacgcagtggctttcaactgatatatgggtgcggagggaaatcgtggatattgatccatatttgcttgagaacaagaagatttatttgcgttattcgtatgatgacatagttcaattatatattaacggaaaactagtcgtaagtgcggaccgcgcagcggcaaatttaaaagtcgagttgccggattctatcttgaatacaatgaaggaagggaaagcccttattgcagctcattgtgagaataaaaaaggtagtgcattgattgatttcggcttatttgcagaggagccgggaatattggtagaaggcatagctcctgtttctaatgagaaggaatggattgggaaatatacaacagaacaaccggaagagggttgggaaatggctgctttcaatgatagcgcatgggcacaaggaagcgctgcttttggcacggaaggcggaccgagtgttggtactccctggaataccaataggctatggattagaagggaagtctcattcgatccttccttagtgaaaaacagacaactttttgtgcgttattcgtataatgacggtatgcaactgcttattaatggaaaggagcttgttcgtacgggaacgaaggcacgcaacgatgtgaaagtgcagatcccggattctatcttagaaacaatgaaagatggaaaagccttgtttgcggcccgttgtgtgaattggggaggtacttcctttgcagatttcgggttgtatggtgagctgaaagaagccgggcaaaaatcagtggatgtgcaggctacccaaacacattatatttttgattgtggagatgtggaattgaaactgacatttacggctccttatttattggatgatttggaactgttaagtcgtccggttaattatatttcttatcaggctaaggctttggatggtaaggagcatgatgtcgctatttattttgaaatggatcctcataaagcctttcgtgccggacagtctacggagatgtatgaaaaagacggttgggtgatgatgaagaccggtcgggagaatcagaagttatgggtggataagctgaaggatgctccggcctggggatatttctatttaggagcgaaagagaatgttacttgtgcacaaggggacgcggcagagatgcgggcgcattttatgaaagaaggtgatttgaaagaaatgcgtcggtcgaatgaaaaacgttatgcggcgatagcacagaagctggaaatgaatagtgagtttcctcaacatctgattgcggctttcgatggattgtatacaatggcttatttcggtgaggacctacgaccttattggaataaggacggagataaaacgatagaagggttatatgaagacgcggaaaaagtatataaagaaacaatggcaaggtgctatgcttttgacaggcaattgatggaaaatgcttgccgtgtcggtggtaaagagtacgcagaactgtgtgcttcggcatatcgtcaggccgtttcgtctttccagatgtctaagaattcgagtgatgagttgctctattttaccacgttggtgggttcgctggatatttattatgctgcttcaccgctatttctttgttacaatcccaatctgctgaaagcaatgttgaatcctttcttttattatagtgagagtggtaaatggaataagcctttcccggctcatgatttgggcggttatccgtttgtaaacggacaagcgaaagggggagatttaccagttgaacatgccggaaatatgctgattatggtggctgctatggctaaagcggaaaaagatgcatcttacgcaaaggctcattgggagactctctccaaatgggcgggttatttgatggagaacggggttgataccgataaacagattgatactgacagctttgctggccgctactctcataatgctaatttgtctgccaaaggaattttaggtattgcatcgtatgctcttctggcaaaaatgctaggtaaacaggaagatgctgaaaaatatttggcagcagcaaaaagaatggccgaggaatgggagaagcaggcttctgacggggaccattatcgtttggcttttgaccagccggatagctgggggcaaaagtataacttgatttgggataaactccttgaccttcatgtttttccggatagagtagtagaattggaaactgctttttataggactaaattgaatacttacggttgtccgttgcatagtaaaactgattatgcgaaagctgattggactgtatggacggctgcattgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatagtaaaactgattatgcgaaagctgattggactgtatggacggctgcattgcaaaatgaccggcttatgtttcgtgagtttattcttccgctttacaattatatgaatgaaaacaaatggcgtgtaccaatggcggacacttataatgttgtgaatcagaaaacaagagttacatcatggggaagaccggtaacaggggcctatttcataaagttattagagtaaaatgtaggttggctctattgtaagtatagagtattggataattgtttgagacatttttaataactagttattaattggcacttttattttaacatcgaaattgataaaggaagggggttgttagcaaaaataaaaatgatatttaagattatagtggttctgttgccgtcgaagtgatagatgcgactaaaagtagttttaataatttaatacctaattgaatatgaatagtactatattaaagaacggagtaacaatatttaatatatttatggcttccacttttattttctggacgattggatgtcagtctgatgatgaattggaatctgtaaacaatagttccgtggtggcatgcacttcagaactagaagattttattattgctgcaactgatttacagcaatcattaatagtttttgaaaaagaacttataaaagtgaattttgcagatcttgaaactgagatcaatgcggatggaaataaggttacacatttaccggctattattcgttcgcttaatattgagcaaaaaatattgttaatgaatcagaaaaaggatgcattacgcaataaatacccacagtttgcttccatggatttcaatgagattgctaagaatattgattattgtattgataactcaatgaggattagtgagttttttgatgataaaaatatcaatatccatttgcaaactactagatcattttttaatgaatcatataacaatatgaatgaattagtagggcatttgtataattgggcactttcatccgattatgtagaggttcatattcttacatttagtgatggtacatatacagtagttgaaactagtggaaatactgcaaatagtgctagcttatatgggctaatgcttgatactaccaataaaaagtattattataatggaaatcaagttgtagctattgctcatacgcatcgtaatagttctaatccaagtcaaactgaccttgataatagacttccttattgtgaaaatgcaatatattataatggatcttttaattctttttaaaagatagattcctatgaataaaagtttcattgtatttgtgttaataatgtttcttaatgagaatatattttctcaagaagcagagcatataaatggtggatctttctctaaaaagattgaatataacataattgttgcagggaatgatcattgctataatcttgaaggtaaatcaatattagacagaatattcttcggaataactaattcacctgttgagtttgttatcaaaagctcttttgatggggcttctgcttttcgtattgtagataattcttccgatagttcatctttgatagaaataatgtatttgcccgatagtgagaaattgtttgagatggagcgaatattatctgcgcaagtcaatcgaatacttattccgggggagttactgaattcaacttcattaactattagtgacatggaaaaaatcaagaaacataatgatgtagctgaactttcattgtatcgtgatgatttgtataaaccttatcgtccgcaatctatatcattcaagataagcactgatttatcccaaaaactatatagtaaaatggtgatgttgattaataattttagggccgaaggtatccctccaataatttctgatgggcatgcagttacatttcgttgtgtggttaaggatgaattatggacactgaatattaggatccctcagaataaggctctgcttttgtcggaaatatgcgagcaaatattggttgacgtaaaagcaaatgagtttaatgaaagtaagtattttaaatctcttgatcaattagatttttgaattaattcctagaatgaatatctcctgcttgaaagaaatactcaagtaggggatattcattataacttaaatgaaatcatcagttactatatcatctatgtggagcatgctacaaaaacattctgttttaataataatgttaattgtaatgtttgggactacattttgcaatttcagtgagtttattgattatgaattgaaatccaaatggtattgtctatatttgatgatatccatatttataccgttgtttttattggctagctataaaaataagatggcacaacagatttgtgtatctaaatctttattgacgctattacttttatatttttttataaggattgtttttggacaactttctctatcaaatgttgcattctgtttattattcattcttttatattatttacttgctagtatacaggttggttggtcgtttgtttacatatcaagttcagttattgtagtttctttgtttatgtctttgtatggtatagctcaatatatcggtttgatatcttctagacatctcttcatggtagtcggaagcttcgataatccagctggttatgcatctatgttgtctatgagtattccatttgtatgttattatatttattctgataaatgtaataaaaaaactcccctatggtttatttattttgtgattgttttagcgattactttgtctgcctctagaactggaatattaatatcaattattataagtgttacatatattatcaaaagatataaaataaatttttctaatgtcactttgtggcttaaatttataatgatgttgttggtaattgcaattatattagggttctatatatttaagaaagattccacaaaaggccgtgtaattatatggagatgtacatgggaaatgataaaagaaaaaccttggtttgggcatggatataaaagttttgaagcaaaatacatgttatatcaggctgattattttgaacaaaataaaaaaagcgactatatcttattgtctgacaatgtaaaacatccatttaatgagtttatcctcttaattgtagagtttggtttctttgctttttttctgttcttgttgtttgtgatacaattaatattgttgtaccgaaaaaggcaaacagacgaatcgttttctttgatgttgtcattattggctattgctattttttcctttttctcttacccttttcagtatccacatacatggctcatattttttatgtgtgtacaattaatattatttgataatagagaaaaacaatgtaagatatattggccatcaaaatttatagttgtgttttcatctattttattatttagtataactgttaaagagatgtattttgagaacaaatggtatttaatagagcataaaagaaaatttggaaatattcaggaagttatagctacatatgaaactctctatcctcatttgaaaaaaaatgcttatttcttatataattatgctgcgaagcttaattatttcggttattatgaaagaagttgtttcttagttgacaaatgtaggaattattttaatgattatgatgttcaaatgcttattgctgataatttattccatttggaggaatggaataaagctaagaatcattatagtaaggctttttatatgtgtcccaatcgatttgtccctttaaaccagttacataaaatagctatattagagaatgatagtaatatggcacgaaaaatagcttgtttaatcattgataaaccaacaaaagtaccatctgctacagtttataaaataaaacaaaaaatgcaacaatatttagaaactgatataaactgtattgttaaatagacatctttagtatatcggatgcttacgaatacttacggttgtccgttacatagtaaaactgattatgcgaaagctgattggactgtatggacggctgcattgcaaaatgaccgacttatgtttcgtgagtttcttcttccgctttacaattatatgaatgaaaacaaatggcgtgtaccaatggcagacacttataatgttgtaaatcagaaaacaagagtcacatcgtggggaagaccggtaacgggtgcctatttcataaaattattagaggcggttttggatgaaaaaggtaataatatcgtttcaaaagatgaaatgaattgttcaaagtagccttgataaaataggtgcttgaatgttataattatagatgaataggggatatttcgtttgtctgtatcttacagagagcgtgaatggtaaccttatggattgtaatatactattgaatgatgttgatttaatgtatatctttgtatagcaatacaagatgaaacatggaatcaatataaatcccataaataaaatcagataattatgaaaaacattttccttcccaaagtaacgatgtgtataattgcactgcttgctttaattttaccagtttctgcacaaaatacaaatgtgacagatgagtacaaagaaacgttgaagaaaatcatggatttttctggtacttcgactactacggatgactttttccagaaattatcatctataatgaaattaaatgcgccgaaaaaggatgaggcttattggaatgagttctctaaaaattggaaagagaaagtagaaaataaggtgtttgaaatgtatatgcctgtttatgaaaagcatttaacattggcagaattaaaagctgttgctgcattttatgaatctcccgtaggtaagaaatataaagaggcttcattgatggttatgcgtgagacaatgccgctgctagtggagcaactccagacagagatgtccaaagagataatgccggagaaaagtgaacgagtaaaaagaggtgaacagcggttgaaagaatatgagcaaaagcagaagcgtgataaagaattatatgcacaagcctatatgcttccaagcgatagtatagtgatagttcctgaagaagtgtatgagaaagcgtatgagaatgggaggtctacaaggccttctttatattcgattgaaaggagaaagaatgatactaaagtgacattcatacaacctatttattggaattggcaatggttgtattatagtccggggtttaagattgttgataagaaaagtggcgatgaatataatgtgagaggatatgatggtggagctccgatgggtaggctgttggctgtcaaaggatttaatcataaatatatttatatcagtcttttattcccgaaactgaagaagagtgtgaaagaaatagatattcttgagttgctacacaaaaaagataaagaacagttgccttctaatgatgatggaaagtctaaatcatattttaatataaaggtgaaagattatcagaccatttccgataagaaaaataagaagatctattattagtttaaatgattatcagaatttgaaatgataatagcaggtattgaacatgagtgtttactgtttttgatataaatttattctatatgagaaatcgaattatgattttatgcacgttttgtgctattgctatattttcttctgcccaagagaaattctctatccaaggaattgctaatgaggaattgaataatcaattgttgtatttatgtctgatgggagatagagagaaagccaaagaagtcgttttggacagtacaacagtggaaaaaggtaagttctctttttctggtgtacatcagatgccggatattgcaatcatcaaggatatggatggagaaacctatccgttgattttcgaaaaaggagaaatatcagtaaatattgctgcgaataagagagggggaacgcctttaaatgattcattgaatatagctttaaatcgtatgcagctaataatggataatatgttgaaaacatcgaatgatatttataagttaatgcttgggatgaaaccggaagtattttcggataagatgaggaatgatactgtatttaaagcggaatttgatcggaataataaattatttcttgcacaaatggattcagtatcacattgtataaaggattataagaatagtatagtgggtgtatatcttttctccgttggaggtatgatgatgccttttgatgatatgaagattctgatgaaagaagcttcgcctctgttttcacaaaataatttggtgagaaatattgtggaaaagaagaaccaagcagagctccgaatgaaggcggaacttgaaaataaaatgactccggaacagcgtgaagaacaaaagaaacggcaggaaatggatgccaagataaagattggcgaacgtttcccggatgctaaagtgaaagacaatgctggcaacatgaagctcttgtctgattatgtgggtaaaggaaaatatgtcttgattgacttttgggcttcatggtgtggaccttgtcggcatgaaatgcccaatgtgaaagctgcttatgaaaaatatgcttctaagggatttgaggtgattagcatatccacagatcggaaactgaaaccttggagggctgctgttgaagaacttggaatgaattgggtacaattgttggatgtggatgcttctgatatatatggtatctatgctatacccagaacttttcttgtagatcctacgggaattgttatagacaaaaatttaaggggtgaaaaactggaggaagctttatcgaagttgtttgaataatcgttgctttgtttttattgtatgggtgaattgatagttgagaactatataataggataaccactatcaattcaccaatgacttttattaaatcagaagtccgtccaatagctctaaataaagtccgatcgcttcttctatttcttttaacatgatatattcttctgccgtgtgtgaacgtgacgaacgtcccggaccaatttttaccgatgggaaggacattaaggcctggtcggacaatgttggagaaccaaaaggaacgcgtcctaacttcatagctttctgtacaaatgggtgcttttcgtcaattcgtgaagaattgagacggaatgaacgggcttggggttcacaggaaatatgctttttgatttcagcaaacagttcttcatttgagtaaagctcgttactccggacatcgacgatgaaagtacatttgtcgggaatcacattgtgttgtgtaccggcattgatgacagtgacactcatctttacgggacccaacaagggtgactctttctcaaaacgatagtcacggaaccaggcaatatcatctaatactttgtaaatagcattgtctccttcattacgcgctgcgtgtcccgccttacctgtggcagtaacatccaataccattaatcccttttcggcaatggcgggttgcatctctgtcggttcgcccactatggcaaatgagactggaggaagtcccggcaatacgctctcaattccgtcttttccagaaacttcttcttcacaagaggccagataaatcagattatacttctgcgaagtgcgacatagttgcaggaacacctgtaataacgaaacaacgctggcaccggcatcgttacttcctaatccatataacttaccgttttcttcacgtggagtgaacggatctttccgccaaccgttaacaggtttcactgtgtctatgtgggagttaagtaaaatagtaggcttcttcaaatcaaacataggactaaagcaccacacattatttcctttacgtcccgtctgcatacctgccatttcaatatagttttgcaggaaatcagcagcttgggtttcttcccggctgattgaaggaatactaatcagtgatttaagcaggcttacagcctctgttgtcatatacggaatatcatatttcatagtgcaaatcttttatctataccttaatatttgcacaaagatagtcgttttgagcaatagtttcaaataaaactaatacctttgtaccatatttactaatacaaagagtatgacttatcatcatttatctgtcctggtccatcgtcaggccgaaaaatatggcgacaaggtagccttaaaataccgtgactatgagacagctcaatggattcctatttcatggaagcagttctccggaacagtacggcaagcagctaatgctttcgtggcattgggagtggaagaacaagagaatatcggtatattttcacagaataaacccgaatggttctatgtagactttggtgcatttgccaaccgggcggttaccattccgttttatgcaacgagttcacctgcgcaggcgcaatatatcattaatgatgcgcagattcgttttctttttgtcggtgagcaataccagtatgatgccgctttcagcatctttggtttctgttcttctttgcaacaactgataatctttgaccgttcggtggtaaaagaccctcgtgacgtatcatctatctattttgatgaatttatggcgacgggagagggattgcctcataatgatacggtagaagagcgtaccgaacgggcttcttatgatgacttggcaaacattctctatacatccggcacaacgggtgaaccgaagggcgtcatgcttcatcattcctgttatctggaacagtttcatacacatgatgaccgtttgacgacgatgtcggataaggatgtatcgatgaacttccttccattaacacacgtgtttgagaaagcatggtgttatctctgtattcataaaggagtgcagatttgtatcaatctccgtccggcagatatacaaacaaccattaaggaaattcgcccgacactgatgtgcagtgttccccgtttttgggagaaggtgtatgcaggggtacaggaaaaaataaacgaaacaaccgggttgaagaaggcactgatgctggatgctatccgggtaggtagaatccataatctggattatctgcgtctgggaaagactcctccggtgatgaatcaactgaaatataagttttacgagaagactatctattctttgctgaaaaaaacaatcggtattgagaatggtaactttttcccgactgccggtgctgctgttcccgatgagattaatgaattcgttcattcggtaggaatcaatatggtggtaggatatggactgacggaatctacggctactgtatcttgtacactgccggttggctatgatatcggttcggtaggtgttgtactgccggggattgaagtgaaaatcggtgaagacaatgaaatcctgcttcggggtaagacgatcacaaaaggctattacaaaaaagcggaagccacagctgccgctattgagccggatggctggttccatacaggtgatgccggttactttaaaaatggacagcttttcctgacggaacgtattaaagatttattcaaaacatcaaacggcaaatacgtcgctccgcaagctttggaaacgaagttggtcattgaccgttatatcgaccagattgccattatcgccgatcaacgtaagtttgtctcggctctgattgttcctgtatatggatttgtgaaagagtatgccaaagaaaagggtattgaatataaggatatgacggaactgttgcagcatccgaagattgtaggattgttccgtgcgcggatcgatacacttcagcaacaatttgcgcactatgaacaaatcaaacgtttcactttactgcctgagccattcagcatggaacgtggagaattgactaatacactgaaactgaaacgggcggtggttgccaagaattatagtgagcagatagagaagatgtacgaagaaagtgagaaataggcgataagcggtttatcgttaaaaatgaaacgataaaccgtaaatgataaatcggaaacaataaagagtgtattggagctctctttaaaagtattacccctgttacagttcaatttgtaacaggggtaaactttgtgtttaggggggcttttgacacctgctaattatttatggccggctcgtttctttttagtatccgaaaatctgttcttgggtcaattcttcaataggacctacagctttcaatttatccagctccaaatctttcttatctcccaggatgcaataaacatacgtacgtccttttacccattgcttttggaaatcgacaatatcttttagcgacatgttctgtatgtcgttgtagagcttgatgcgcgggtctacgttttgccctaaatcttgtgcattgatataactccagataatgtcacctttgatgatacgttcggtgcgcagacggttggttaatccgtctttagccagtttgaaagcagcttcggattccggcatattattgatgatgtcattaaatgtagtgacggcatcaatcattttgtcgttttgcgtggcaatctgtgtacgtagtacatagggatacttcaagtagctcggcggcattatgctagcccaggcggaataagccaatccacgtgtttcacgcatttcctggaagacgatagagttcatgccccctccgaagtattcatcatataatgcgcggataggttcaatggcaggatcatacttcttatcgagattggatatctgtgccatgtatatttgcttggcgtcataaggagctactagaactttagtgacgggagtttcgagataagaatactcgtttccggcaggaatatccttcagggctgccggaacctgatgatattggttgatggtagccagtaaatctttgctgctgcttgggccgtagtataaaatacggtgcttgtagctgttctgattgtgaatccggtctaccagttcctgtggattcatatttgtcagttccgcctccgtcagtagattggtggcaggggatttgggaccgtacatggcaaagctcatcaaacgggagaagttctgtccctgattcagtttggcgtccgaacgggctttcagtatatcgctggtcatattagtataggcttccttattaacctgcgcatctgccagtagcttttcgaataattgtacggcagcaggcatattctcattcagtccggaaagtacgacatacgtgcgttcgttacccggagaaacatagaaagtacaagccaggcgatagaattcacttttcagttcttccggtgtcatgtccgaagtaccgagatattcgagataatcgaatgctgttcccaaagctttgtcatggttgtttcccatatcaaagacataaatcaattggaacaggtcattggctacattctgtttgtaaagaaccggaatatccgattttgcctttaattggctcatatccttttgataatcgagaaacactggttcaatcggtttgactgcgctttcctgtacctccacaaggaacgggctggttacatcacgattggttatgataggagtaatctccggtttcgtcatcttcttttcgttcgggtcttttccttgctttttgtagataacggcataattatcttctttcaggtatttgttggcgaacgctacgatgtcttctttggtcagtttggccatgcggtcgatggcagtaacttcatttttccagtctgtgccgttgataaatgagttgacaaacatatcggcacgtccttcgttgctttccatgttttgcagttcaccgagcttgaaattgttgatgttcgcttccagcattttctcgtcgaactctccggcacggagcttcttgatttcgctgagtagcaagtcttttacctcttccagtgtttgtccttgtttaggaagtcctcctagcagcaatgcagagtaatctgccagtcccatcgggtaaccgtaactattcaagaccttctgttgctggttcaggtcaaggtcgataagtcctgcctttccattgtataatacttgcgaaacgacttgcaggatttcaaaatccttgtcggatacaccggggaatctccaagccaatgcgacgctttcggcatccggacctaacacctcttttacaacaggttgcgtgattggcgcctctttcggaaggtccagtttcgggagttccggattgggtttcaatccaccaaaatatttatcgattaatgcaattgttgcatccgggtctagatcgccagacatacagattgccatattgttgggcacataccattgtttatagtagttcttgatattcgtgatagaaggattctttaagttctcctgtgtacctaacacagtctgcgttccataaggatgcttgggaaaaagagaagaaaaaatagcttcctgtactttgctgttgtcacgggtgagtgacatatttttctcttcatatacagcttccaattcagtatggaaaccacgaattacattgttttcaaaacgatctgcctgaatcttcgcccagttttctatctggttggaaggaatgtcttcctgatagaccgtctggtcataccaggtataagcattgctgccggtagatccgatggctgccattaatttgtcatattcattagggatagcatacttggaagcttcgtaagaaaggctgtcgatggtgtggtagatcgccttacgttccgcttcatccgtagtcttacgataaatctcgaactgttgttcgattgcatccagtagaggcttttcggtcgcgtagtcttgtgtgccaaacttgtcggtgcctttaaacatcagatgttcgaaataatgggcaagtcccgtcgtttctgccgggtcattcttcccgcccactcttactgcgataaatgtttgtatgcgcggagtttccttgtttacggtgaggtaaacctttagtccgttgtccagtgtgtaaatgcgggcttttagcgggtcattgggcactgtttcgtagctatacttcttttgtgagctacagctgcaaatcactaatgccaggaagagtgacaagcaagaaagtttcaatcgtttgttcataatatgacaacattttaataacaaaaacaaaggtagcagaattttgcttatctttgtccccgatatctgaaatttgtaaataataaaattgtaaatcaaatgattactattgaacaacttaaagacgtgaaagagcgcactgatgcgctgaggaggtatctttgacatcgacgggaagaaaattcaagtcgaagaagagcaattaagaacacaagctccgggattctgggatgaccagaagagagccgaagctcaaatgaaactggtgaaagacctgcaaaagtggattgaaggctacaacgaactcaagacattggcagatgaactagaactggcatttgatttctataaagaagaactggtgaccgaggaagatgtggacgctgcttacgccaaagctagtgaagcggtagaggcactcgaactcaaaaatatgcttcgtgacgaagccgaccagatggattgtgtgttgaaaatcaattcaggtgccggtggtacggaaagtcaggactgggcttctatgctgatgcgtatgtatctgcgttatgccgagaccaacggttataaagctaccattgccaaccttcaggaaggtgacgaagccggaatcaagacctgtactatcaatatcgaaggtgactttgcttatggttatttgaaaggagagaacggtgtgcaccgtttggttcgtgtttctccctacaatgcgcagggtaaacgtatgacctcttttgcttctgtgtttgttactccgttggtagatgacagtattgaagttaatattttgcctgccaatatctcttgggatacgttccgaagcggtggtgccggtggacagaatgtgaataaggtggagtccggtgtccgtttgcgttatcagtataaagacccttataccggtgaggaagaagaaatcctgatcgagaataccgaaacccgtgaccaaccgaagaatcgtgagaatgcaatgcgtcagttacgttctatcttatatgataaggaattgcagcaccgtatggcagaacaggcgaaggtggaagccggtaagaagaaaatcgaatggggttctcaaatccgaagctacgtatttgatgaccgtcgtgtgaaagaccaccgtaccaactatcaaacctcggatgtgaacggcgtgatggatggcaaaatagatggttttatcaaagcttatttgatggagttttcttcacaagaatcataaaaaataaaattagcaagaattatttttggaaagttaatagatttgtacttactttgttagcgttgaactttaaagctaactattatgggtaaggtgaagaaaaaagtagcaattagtaagaaagaagaagaacaagcccagaaggttgtcaaaatagtgttcgtctcattaattattttggcattgattatgctgatcgcattttcctttttcggctgataagttcgccacaaattatacggttaacccagattgtttggttattgataggataaatatcaaatccgatctgtgttaatctgcgtaatttgtggcgaactctttgttttgtaatgcatttgtgttctctgtaatataaatgtaacttttctgtcattttcccgtagttaatttgtcatctccgtgtatcctcacagttgtacttttgccgtgaatttagtagcagacaactgaaatgagtagaatcagaacaaccgtcgttatgcttttgctggcgacaatggcctttggacaggcaaaagaagatgcaggggatggtaagatgctggataaacagaccatggagtttaaggattatctgccggagattcacggaacaatccggggaaagtacgaataccagacagaaacaagtgaaagccgttttgaagtacgtaatgcacgcttcagtgtttcgggaaatgtgcatccgatagttgcttataaagcggaaatcgacctttccgatgaaggctctatcaagatgcttgatgcgtatgcacgtgtttttccggtgaaagacctgaattttacgatcggtcagatgcgcgttcctttcacgatagatgctcaccgctcaccacatcagcagtattttgccaaccgttcattcattgccaagcaagtaggaaatgtgcgtgatgtcggtttgacggctggttatacgaataaaaaaggtatcccatttattcttgaagggggattgtttaacggctccggtctgacaaatcagaaagaatggcataaaacgctgaattactccataaaagcgcagttattgcccaataagaactggaatctgacacttagcacccaaatgataaaaccggaaaatgtgcggattaatatgtacgatgccggtatctattatcagaatgaccgttttcatattgaggcggaatatttatataaaatgtacggtcacgaagcatttaaagatgttcatgcagtgaatagttttattaattacgatttaccattaaagaaagtattcaataaaatctccttcctggctcgctatgatatgatgaccgatcatagtgatggcaagatggatgaaacgacaaaagctctgattataaatgattatgcccgacatcgtgtgacgggtggaatcacgctaagtctttccaaagctttcattgccgacctccgattgaacttcgagaaatatttctataagaactccggcgttccaaaagaatcggaacgggacaaaatcgtgattgagtttatgacgagattctgaaataaattgagacttgaaaattgagaattaagaattgtagttttctgatacatgatgtgagatgtcaaactatcattttttaattctcaattttcaatttttaatttatctttgtgccatggcacaggaaatagaacgtaaatttttagttatcggtgaattcaagtcttcggcttttgcgcaaagtcacattgtgcaggggtatatcagtagtgctcgcgggcgtactgtccgggttcgtattcgggatgataaaggttatctgacaataaagggagcttctaatgcttccggtaccagtcgttatgaatgggaaaaggaactggccttatcagaagcagaagaattgatgaggctttgcgaaccggggattattgacaagatccgttatttggtacgtagtggcaaacatgtatttgaagtcgacgagttttatggtgagaatgaaggacttattgtggcagaagtagagttggaatcggaagatgaggcttttgtaaagcccgactttatcggtgaggaggtaacgggcgacatacgctactataactcacagctaatgaaaaaaccgtataaaacgtggtgagcgttaacaaataaaccgtatatttgttcttatataaaaaagagagcagtatatggatatggaacagttgtacagttatgtgccgcgtgaattggttacttttgttttagtaaccttgttttctttattaatcggactttcgcaacgtcgaatcagtctgaagcgtgagggggaaactactcttttcggaaccgaccgcacctttacctttattggtatactgggttacttgctttatatcttagaccctacggatatgcgtctgtttatgggaggtggagcggtattgggattgctgttgggattaaactattatgtaaagcaatcacaatttcatgtttttggtgtaactaccatcattattgccctgattacttattgtatggctcctatcgtagctacccaaccttcctggttttatgttatggtagttgtgactgtgcttctgctgactgaactcaaacatacttttacggagtttgcgcaacggatgaagaatgatgaaatgattacgttagccaagttcttggctatcagcggtatcatattaccgatgcttccgcataagaatctgattccggatattaatcttactccttattctatttggttggcaacggtagtagtatccggcatttcctatctctcttatctattaaaaaggtatgtattccatgaatccggcacgttagtttctggtattattggtggattatacagcagtacggctacgatctcggtacttgcccgtaaaagccgaaaagcatcagagcaggaagcgactgattatgttgctgccatgttgctggctgttagcatgatgtttctgcgatttatgatactgatacttattttcagtagagaaatcttcctgtctatttatccatatctgttgactatggctgtagtcgcggctattgttgcctggtttatccattcccggcaaaaacgaccggaagaccagtctgctgaaacagaagaggatgatagtagcaacccgttggaatttaaagttgctttgatttttgccgtactctttgtgatattcactttcttaactcactatacgttagtgtatgcgggcacaggcggattaaatctcttgtcttttgtttccggttttagtgatataactcctttcatcttaaacttgttgcaaaatacaggtagtgtggctgcattgataattactgcttgtagtatgcaggctatcattagcaatataatggtaaatatgttctatgctctattctttgcagggaagggaagtaaacttcgtccttggattttgggaggattcggtgtggtaattgcttgtaatctcgttttgttgctgttcttttatatttaagaaatagagtaataggttctttttcataggctcaaattctagtaatttattattttgtcgaatataatcgataaaatagagatatttttatcgattatattcgataaaaatagtctatatttgtcgaatataatcgataatgtaaaatggataaggaactgataaaaggattgatagctgaatatcagcagtttgtaaagagcgtgtcattcgtgaaacgtgcggtgactctatctgataacttcaattatgtctttgtaggtttacgtcgggttgggaagtcttatttgatgtatcagcagatacatcatttaatagagacaggtatttcaccggaagagattcttttctttaattttgaggatgagcgaatagctggtatggatacagaacatcttgatatgataaagagatgttatgaagagatgtattctcatcgtcctatattttttttagatgaaatacagattgtaccgcattgggaacaatttgtccgacggcttgccgatcagaagtacagggtttatgtaacagggagcaatgctaagatgttgagtaaggatatagctactactttagggggacgttttatgattcaatacgtctatcctttctcgtttcgtgagtatttgtcatctaacggtgttcaattagataagctttggatttataagaaccgttcggaggtagtccgacatttcgatacttactttcgttttggtggtttacccgaactgttagtggccgagggacaagagaaacgacaatggctgagtagtctttttaataagatattcttcggtgatttagtggctcgttattctattcgaaatgatatggcgttaaaggtactcattcgaaaactggctgaaagcgtgaagcagccttcttctttcactcgtctggctaatttagtatcttccacaggcaagaagattaccactgatactattatagactatttgaattatctggaagatacctggatcatgttttctttagaaaactacgctagtaagttagccgataaagtgtccaataaaaaatattattttatggataatggaatacttagtctgtttttaatggatccggaaacttctttattggaaaatctcgtggcagttacattaaaaaaacggtatggcgatgatttatatttctatcatcggaatatagaagtagacttttatctggatgaagggcataaggccatacaagtatcatatagtttaaaagatccggagactcgaaaacgagaagtgaatgccttactgaaacttgcagaaaatgtggcagtggatgatctgtgtattattaccagagacgaagaggaaatgatcgtagaaggagagaagacgattcgggttgtgccggtgtggaggtggttgctggatgatgaaggatgaataagctattcctgatttgtaaagatgcctggataataaaaattcaggactaaatattaaaagagggtatgccagattaatgtgcacccctcttttttattatatttaaaaatcacatgaaatcttttatctaatgattgctagtaacgtgtcttgttttttaccactgccaatcatttacattataagttgcttctactgtattttcgatattgtcgggtagattatggaagaaatctatgccagtttcttgttccaaagcatcaatcgacatgagatatttctttgggtcttttttgtcaggatcatctttaagattttcgtgaggcatataaaatcctattgctttataattatctccgctacggaaaagtactgccataaagaaatattttggaatagctatctcattttttatatatccttttatcatgccttctccaatagttcctccttttacaacatatagtgtatctgttgatcttgaaatgttatatccccatgcttgtactttgtcttctcccgtattccaggcacttccactttgattgaatccgttaccagattgcgggcttatgtttgacatatagaatgtttgttgattggcctctttggagtactgtctgtctgatgatgcgcataaatgccctctagtatatccggaatttgtatagtcgttgtgctttgccgcatattgtgatggtaattcaggatcgggtttgtatgcttcattacgtccaacatttccgcctgttgtattgtcgaaacgataagctatccaataagaatgtttatacttgtaactgtattccaaactataagttgggtaatctttgccattccgtttagttgtatgagtgataaattggttcatacttccaccttttaacgctggaatctcaagcatgcttgcatatcccgaaggtttttccggatctggaacaggatttgaaccattgcctgctaattgtttgagtgtgaatttggcctcctcttttccggctgtgattgtaataatgacacttcgttcagctccggtatttgctttcatatatccactgatagagccatttccattgccggatgttctactcaatgtacaccaagtctcactacttgaagcctgccatgtgccatcagcttttacacgaatgataaatccgcctccattggcattgatttgtgtttggtcaatagaggcaattccttgattggtattgcctgagttgtctggaagttcaggcgaatcctgttcactacatgagattgcagtgctacaagttatgaacaggatgaatagtttaaataatgcttttgtcatttcacttctttaattagataaataatagtaggcaagtgatcgctatatccgtttagccatacaccacctgcctgtgtccgtttaggatatcctttatattttccttctttttggaacataaaatcacggctgaagatttcatgtttatagaatttcagtgtactgcggtcagtgcccaacaaatttccggtgaatacaatttgatcgaacaaattccatttacctttgtacatcagagttccatatcctttcttcaaagtatcccaccatggattgtacaagtctgtaggacctgcatcaacaggtttccgtttagctccaagtgctacagccatacttttatccatcgggtcatcgttcatatcccccatgataacaattttggctgcggagtcttcccttaacagtgaatctttgatagctctaacttgttctcctgcgcgttcacgtgctggagaagcggcagctctcgaaggccagtgattgacgataaagtgcattttctcatctgcgatattgccgctggcaatcaggaaaccacgtgtcttatgcactgtatcattgatatatacataaggtacgagtttactatttgtcagttcaaacaatttgggattatagaagaaagcacagtccacaccacgttgatcttctccttcgtagtgaacatatcggtaccctctgtccgctaaagctggttgcttcagtatgtcttccaatactctgtaattttcgatttcagaaacgccgataatggcgggacccattggcaacttgtcggtacttaacaggcttaatatttccgacatgtttttcagcttagccttatacttcatcgtattccactgattagtaccgttaggaagatactcgtagtcattcttaccttcatcgtgaatggtatcaaacaaattctccatattgtagaacgctacactgtagagggcaaatttcttttcctgtccataggccatgaggacgaaaagagcgagtacacctaaagtcattaagctttttttcatctttgaaattgattttaaaagtgggtaatttgtcatttgtatgacaaatatctaaaaagaaaacgaaaaacccacccttgcgagttactttttttgtaaaaaacattgttatttataaaattctttgttattttgcgtaacagcttatttcatttgtattgcaaagcgaaagaccaattaacattaatataaattaaattatgaaacaacgactagggttagcgatcgtgctattttgcttaatgccagcactttttgctcagcaaaaggcaaagcaaaacgcccgtgaggacaatgcttctttcatgtttacagaatcacaattgaatgaggatgatgatgcagcacagagcacatctgcattggtcacttctaacaatgatgtttatctgtcaaatgtaggttatctgtttagcccaatgagatttcgtgtgaggggatatgattcccagtatagtgacatgtatatcaatggggtacagtttaatgatgcagaaacaggacgtttcagttacggattaataggaggattgaacgatgctacccgtaataaggaggggatcggtccttttgaaattaacaactttactttcggagccatagggggagcttccaatatcaatttacgtgccagccaatatgcggccggttcaaaactaaccttatcaggtagtaaccgcaactatatcttgcgtggaatgtatacttattctacaggtctgatgaataatggatgggcctttaccggttcattgggatatcgttggggtaacgagggaaatattgaaggaatcaagtacaactctttttcttacttcctcggtgcagagaaagtattcaatgatcgccatagtctttctttggcaacttggggaacacctacagagagagggcagcaaatggcggcaactgaagaagcctattatttagcaaacagtcattattataatccgaactggggatatcagaatggagaaaaaagaaatgcgcgtattgtacgccagttcgagccatcagccatcgcttcatggaatttcaccattgatgataataagaaactggtgacgagtgccggattcaaatattccaattatggtaaaagtgctttaggctggaatggtaatgcagccgatccgcgtccggattattataaaaaattgcctagctctatcttcgacgtgtgggaatccgttcctactgccgatgaactgcagcagtttaatgaggttactgataattggaagaataataaagcttatcgccagttggattgggatgctctttattttgccaataaacaagcgaatgcattaggtaaagagacgctttattatgtggaagaacgtcacgacgaccagttagctttcaacttgagttctgtattcaatcatcaatggaatgagcgcaatagctatgttgctggaattgcagtgaatacaaccaaaggtatgcattataagaaaatgaaagacttgctgggtggacagctttatacggatgtcgacaagttcgcagtacgtgaccatggcgctagttccagcatggtgcagaatgacctcgataatcctaaccgtcgtattggtgaaggtgataaatttggttatgactataacatctatgtgaataagcagagcgcatgggtacgttaccagggtaataatggtggatcattaaattattttgcttccggtaaaatcggatctacacaaatgttccgtgatggcttgatgagaaacggacgtgcgccattgaaatcactaggtagtagcggtacggcgaagttcctggaaggcggtataaaagctggtctgaattgggctatcaatggcaatcattcctttacgttgaatgccggatatgaagaacgtgcaccgctggcttacaactctttcatcgctccgcgtattaagaacgattttgtgagagatttgaaaacagagcgtatcattggtggtgatttgacttacaacttcaatactccttgggtgatgggacgtttaacgggttattacactcgtttccagaatcaagtagaaatggatgctttctataacgatagcgaagcacgtttcacttatctttctatgaacggtattgaaaaggaacattggggaatagaagctgctgctacctttaaattgacaagtgagctgtcattaacagctatcggtacttggagcgaagctaagtataccaataatccggatgctgtgttgacgtatgaaagtgagaatgagtcaaacctcgaccgtgtttatgctaaaggtatgcgtgccaatggcactccgctttctgcttatagtcttgctttggattataacgtaaaaggttggttcttcaatttgacaggaaattattatgatcgtgtatatatcgatttctcaagctatcgtcgtcttggcagtgtattggataagaatggtgccggtgtagatgctaacggaaatccggttctcaatgtaccgggtcaggagaaactggatggcggatttatgttggatgcttctattggaaaatatatccgtttgcgcaatggaaagagcattagtctcaatttaagtttgactaatatcctgaacaatacagatttgcgtacaggtggtttcgaacaaaaccgtgatgataattacaaagacggtgacgcacgtgtttacaagttttccaagaattctaagtatttctacgcattcccgttcaatgctttcttgaacattggttatagattttaagaatgtgtagttatcaatccaaaacaaaaagaaaggaagaaacaattatgaagaaattactatctatattatgtatcggattactgctatgtggcgcaggtctcacttcctgtgagaactatgatgatccggtgacgggaaatgcttatggcaataattcgatcccggaaggacgtacgatttcaatagcggcattgaaagagaaatataatgatttcattgatacgagcaaagatacttatacgactattgaagatgagacacgtattgaaggggtaattacctgcgatgatgaaagtggaaacttgtataagaagctcgtggtggcagatgaaacaggagcgatcgttattggtgttaatgcaaccggattgtatgcattctgcccggtaggtcagaaagtcgtgattgactgtaagggtttgcagataggtagctatcgtaaacaggcacagatcggaactgtttataataatgcagtaggccgtatgccggaatatgtatggaaacaacatgtacgtctgattaatgaacctaaattatactatccagaactgacaccgattgaaattactactccagctgatcttgctgctatagacttgaaagaagctccggtactggttactttcaaagatataaaactttccgaagcagatggaacagcgacttatgctccaggagatgaaggttcagtaaaacgttatttcacttatgctgacggtacgcagagtggaagtaatctattcctttataccagtgcttatgcaaacttctcaatggaagtaatgccgcaaggtagtgtaaatattacaggtattttgttgcgttacaataaccagtgggaggttgttgttcgtactttaagcgatatcaaacgaaataattaattcaattaacacatataattatgaaaaagattctaaatgctttattcttgacactgcttacagtgttcacatttagttcatgtagtgatgtaccggctccttatgatatattgggagaaggtgatgttccgggactgacgggtgatggtacgaaagagaatccatataatatagaagctgcacaacagaaacaagacggttccatagcttgggtgcaaggatatattgtgggtgctatagaaaatgtatatgatgataaaggggaatttgcaggcaataaggccagctttacagctccttttactataacatctaatgtgctgattgctgaaagtccagatgaaaccaatgaaagtaaatgcttgccggttaaaataaagaatggaagtgaactgtctactgctttaaacttgaaagaccatcctgaaaataaaggaggaatcttgttgattcaaggtgagttaagtgctggttttggaaaagcagcattgataaatacaacagctgcagtatttaataataaagagattggcgaagaacaaggtggagaagatttagatcctgataatcctctgggattagatacttcagtagctccattagtagatttatctaataattttgacgatgttcaacatcaggcagattattcaaaagctggttggattaataaggctgttaaaggaaatagaatttggcaaggtgctatttatgatcctcaaaaatatttggcagcttcaacttatggggtaaatagtggtgagacagcagaatattggtttgtgactccttattttacagttaatgccgataagcaatttacttttaaagctactgtaaataagtattctgaaacaatgtctctgaaggtattcttcttgcagatgaaagatggtaaaatggaacgccatgaaatatctgttactggtatccctacttctggtacatatcaatggacaagtgatttaaaggtagatttaagtacttatgcggggcagaatggttttgttggtttccagtatatggcaatgcgaggtgaagaggtacagacttatggaattgatgatattttgtatggtgaaggaggcggagaagttcctggaccgggagaaggtactgaattgttaactaatggaggttttgaaaactgggctgatggatatccgacgggttggaagtctgtatctacagcaagcagtgcaactctagaacagtctactgataagcggagtggtacatcgtctgttttagtaaagggagacccatcaagcaataagcgactaggtagcatagaaatgacattgaaggctggtacttatgtgttttctgcttattttaaggctgctacagctgataagactagtgctcgtttggggtatgttccaattgatgaagctggtaaacctggaagttatgtatatgatgaatatgtaaatgagatcactaatgcggattgggttacaaaaagttacacattttctttgacagaagaaaagaagatatgtttggttgttatgaatcctaaaagtccgggaaaagatttgttgatagatgatgcaagtttgaaaactgaagatggaggtattgtaggaggtggaggagtagacccggagccagaacaaggtaatttggtgattaatccaggatttgaaaattggactgcggctttacctacggcatgggataatgcaacttacaatacaggtatcaccaaagaagcatcaatagtgcacggaggtaacttttccgtgaaacaggatgcaacagctaccaataaacttcaacaggaaataacaattgaaggaggaaaaacttatcgaatatcatattggtatttggataatactccaaatgcaagaactcgtccgtggatattctgggtagatggaactactactttgaatgatcatgttaatgatttacgtcctagtacttattctgttgataatgtagagtggcaacagtattctaaaacattgctagcaccagctacagcaaataaattacgttttgaagtgagaacttataaagaaggcgataattctggatttatttattttgatgactttgaagttgttgaagtgaaggaatgacatacattttatgacaataagttaattgcaatcttttaatctaagtttaacatctctcttgttctattcttatcctggaaagaagaatgagagagatgctaattttatgagtttctcatatttgttcgtgaagcttgtatggcttatttaaatgaatttatttgatagatataatttcgtccattttgtttgattataataatacaatatatgaattatagatttttatattgggggttgagtctgttatgtataagtttctgtgcttgtgataaagatgataataacgactccaataattttgccactggcatcgtagaactacctgcacttcgcaatggtgcaaacgatgtgtttgtaacacactacaccactttcaatgggcagaaagtaacctctttcagtatggaatacgataagagtaagaagcattcccgttgggttgcttttcgattcgataatcaaactagactgcaaggggcaactcgtggcgataattttattccggacccttctcttgatacggaatatcagcgtactcaagtagattttgggaaaaaaggttatgatagagggcatctttgtgcttctgccgacagactttatcgacaagaagctaacgaccaaaccttttattacacgaatatgagtccgcaacggaacaattttaatacaggtgtttggttggcattggaagggcaagtacagtcatgggggcgtagctgtacagcttcagataccttgtatgtagtaaaaggcggaacgattgataaggaagaacaagtcaaagaatatataggtggcgaccgtagcaagcctgttcctaaatattattatatggctttgttgtttaaaaagggagattctttcaaagcaattgctttctggatggaacatacggacagcaaaccgtcaaaaacaataaaacttgttgactatgcattatcaatagatgaactggaagaaaagacaggaattgatttcttcccaaatctgaatgataatctggaaaatgcacttgaggctacgtattcaacaaaagcgtggccgggattggaataagatcaccacgttaataataacagtctcttttcaaggcggggtatacttcaggattctaccacccatttttcgatattacgggttttctcactgaagttaattcctatcttgaatagtttccgtccatccgcttcgaaaggtagcgcatagcgtttgtcattaatttgctgcaaagcctcttctgctgttccgtttagcttgaattccattatataaatgaacttctctgtctgtagtacgagatctatacgcccgtcattagtgtggtattccaccttggtatagaagccaaccagcttgaaaacgatgaaaagtacgttctcataatgtagttcctgctcccggattacttcgtaagtcgtatcggcaaagaaactctgcaggcggtggaagaaagaatcataatctcccgtttctacttcacggacgaatttttgaacttcaaatggggattccaccttattcacattcgcgtaaaaaggaagcagaaagcgaatgaatccttcttctacttcacggttggggaaacctaaacggtatatgccaaaacgttcgtcatatcctttaatggtgaggtatccgctttggtaaatcactggaatcgggttggttgattcggagtcgatgctattcagtacttgtgcatcagtttcttcgtgtgccatccgttccagatcataatgatgcttttttagtaacttaaccagataggtaggtgtgcccgtttcaaaccaatagctaccgaactctttatatttgaaagcattgagcagactaaacggattatatatgccgatagaattatgcgtaaagtgataaccgtcataacagtcttttaattctgtacagagcctatcatatgttattccgcgtgcatctgcgaattcatgaagttctgtttccagattttcgtgaatttcctggtcgctgacaccgcagatttcaacataatccttccgcattgatatgtcatccagattattcaagtcgctgaacacgctgactttgccgaacttggtgacaccggtcaagaacgcgaactttatgcacccatccattgttttaagtgccccataaaaaggttttaaagtatcccggaatttcttttgtagctcttcgttaccgatggcttgcagcataggtttatcatattcatctaccagaatgactacgcgctgtcctgcctgcttgcaggcgcgttcaatgatgccggcgaaacgcagggaaaatgaccgttcggatggctcggctccatagagcttttcccaagcagtcagcgatttttcgagtatattatccaggctctccagagtgtcatatttctcgatattaaggtccagatgtagtatcggatatttaatccaatccttttccaacctttctacagccagtcctgcaaacagttctttttttccttgaaaataggcttcaagagtagagatgagcagactctttccgaagcggcgcgggcggcttaagaaataataactaccggtttttaccatttgatacatcaatgccgttttatcaatatagaaataaccgtcattacgaatcttttcgaaattctgtataccaatgggataaattttagtgctcatatactccggttttataaatcaattacacaaaggtaataaatttccgggtacttcatagcttttaaaaaaaggaaagtataagtatagttgcttttaactgaatgaggtgtagaaaacagtacgtactgtttgtgcagaaatgagttaaacgttgcgctaatgaatgggtcaagggtgagggatggtgagggtagatttataaccttttattttattattttctatactatctccttttttatctataaaaaaaaatacgaaagttataaatctaccctcaccatccctcacctttgacccatatcttataataaaaagataacggggaatcttaaaaactcaatcgtctttttcagatttatcacaacgttttcagaatactccattattttattcaaaacagtctggaatgaatcaaatttcagggatatggctgtcctgaaccaaatctcccaggagttacaattgggccggtttgctgaatatacataacttccagcatttattcccatatttccaccacataaaaaaaatatgtatatctttgtcgtacgctttctgctcatcagcgtgatgaaactagtagaaggcgctatatattacttaattgagtatatgtgtattatctctctcttcctaaaattagcaacttttgtacggagagatgattcgacagatactccacgttaacgactgtatatcaacatatccggtaaagatgtgttatatataaacgattgacgtgggtgtctgttgttatcattgtctagtacaagggtattgctagccttaggaggtagataatggtgcaacagcatccacgtcttttttgtgtccggtcggttatgattacccccaaaagtctaacctaaacaatttcccgtccgcccgaaatacagaaaacgtgaatgcccgttgctccacataaacaaaataatattcaatctttattgtggaacacattaaaacaaaagcattatgccaaaatggattagcgtagaagaagcggcggccaagtatggaatcaacaaagaagtaatctggctttgggcggatatgaaaagattcccgatgtcgtatgagaaaggtatcaccactgtcgatgaagaaagccttatcggattcctgcatcagaataaggatcgagttacagccgagtatatcgacacattagaggacctgtgtattggaaagacaaagatttgtattttatatgctgaaatcattggttatcaggataaagaactcctgaatcaaagggagcaaatcgctcgaatgaaagagatacaaatagtcatgaaaagacaaaataaccggattcgggattgcgagaaactttttgcaaaatatgagaaaaactttagtgtttgttggatgggaaggttgtgtgctggcttgaggcgcctgatacgatgacaaagaatggaggcaagcatctgataaaaagtatatcggagttgtaccggaaatttccaataactatttttcaggtacggattacacagttttagccaatcaaaagaccgcataatccgtatctggtaaatgtttcatgtttatcttacccggaacttaaaccatctgtacgtggaagatgataaatattataggtgtaacttatcagatgttattttattttgcttggaaactttttgtttgtacatcacgggagttcggtcctaccataacatcaaattctccgggttcgtaaacataatgtaattcggaattatagaatttcaagtcatcttccgtaataacaaacttaacatcgcgactttccccgctcttcaggaagacgcgttcaaaacctttcagctccttcaccggacgggcgatctccgcataaatatcatgaagatacagttgtacagtttcgtaaccatcgtagttccccttgtttgttacagtgacagacacagtcaactcaccatttttaggcaaggtttccgagctaatctgcaactcaccataaacaaagtccgtataactcaaaccatatccgaacggatacagaggctcattgctctcatccagataattgctggcatagcggttgaatatatgactgtcgggatcaggacgacccgtattcaaatgattgtagaataacggcagctgtcccaccgaacgcgggaaggtagttgtcagtttgccacttggagtgatcttgccaaacaatacatcggcaaccgcgtcccctgtttcgctaccgccaaaccagacattcaatatggaatgaacattcgcatcctcccagtttaagactaaaggacgtcccgtgaacagaagaagtacgacaggtttgcccgtcttcactaaagccttcaataaatcctgttgtgcatcgggtatctcaagactggtgcgtgaagccgattcaccgctcatttccgcacattcacccaaagcggcaacaatgatgtctgaacgggaagccatgcgtaaagcctcgtccaacagttcccggttgtctccacgttccagcgggcgaatgcccgtagctgctttttctgtttccgcatcataatatatgttgctgcctttcgcatatagaatttcagccttgtcacccgctgccgcacgaattccttccaacaatgttctgtgacgagacggcgtacatgtcatgctccacataccgcacatattattacgtgcgtctgccattggaccgatcagggcaatcctgcctttttgttcaagtggaagcaggttgttgtcattcttcaacagaacaaatgtttcagctgcaatcgcacgtgcagcagaacggtgttcaggcgtataaagtttctctttggcacgcagggcatcgcaatatttatacggattggagaacagtcccagtttatatttggcttccaatacacggcgacaagccatattaatctgctcttccgttaccttcgcttctttcagggattcctccaatgtattgaggaacccgcatgaaaccatatccatatccgttcctgcctgtaaagcgcgaatggatgcttccttcagaggggcgacaccatgggaggacatttcggctatcgaattgtaatctgttaccaatagtcctccgaagccccattcattccggagcaggtcggtcagtaaccatttgttggctgtggctggaataccgtcaacgatattaaacgagctcatgatgctgcctacaccagcgtcaacggcagctttataaggagccagatattcgttatacatacgtagtcggctcatatccactgtattgtaatcgcgtcccgattcggacgccccataaagtgcgaaatgtttcacgcaggcaagtatttcatcgttgccttgcatattgtttccctgataaccacgcacatacgcttttgccattaaagaacccaggtaaggatcttctccgttcccttctgcgatacgtccccaacgggcatcacgacaaatatcgaccatcgggctgaatgtccagttaataccgtctgcgctggcctcaatggcggagatgcgtgccatacgttcgacggccagcgtatcccaactacaggacagtgccaatgggattggaaaaatagtttcgtaaccgtggataacgtctgcacctacaagtagaggtattttcaaccggctttcttctaccgcaaggtgttgcagggcattaattttctggatccccttgacattgaagaagccgcctatttcctgtttgcgaatcatatcgctaagttcaccgtttatcaccgaacctgtcacgagatcaccgcccgaaggcaggtttaattgtccgagtttctcacggagagtcatccggtccattaagtcggtaatgaaacggtccatttccctatctttccctcccccggatggtgagcaggcaaagagagtaagcccgcaaagggcgcaagatataagatttcttatcttcatttttcttgttattgggttatttatacttgttgtccgatttttctttccacaccactactcccgcaggttcaaggcgtgcactgccaatcagtacttctgcctcatcgggaatgactatttcctgaatgtccgacgtataattcaaggcgatgtaaaaaccgtcacgccattccttcaccactccgtacagtaaatcttcagttggtacgccggcttccgtatatacacgacgtactacttctttctccaatttgccgtcatcggtatccgttccgatataggtgaccgttcctttacccagcctacggtgtatcacggaagcagctcccttataaaactggtctgtatagacagcccacacatctgttccggcagccggggttagtacgtccgcccaattgttccaggcgtattcctcactgccgaaatctacttttccgtagagactgtgaggcagatggtcatagtacaagctgtttattccggccagttgatgaataggagccgctaaaggagcctcccacaatttggagtcacggtctttctgaccggtacggcaggtcagaatcagatgtcccccattcttcacgtattcagtccaacgttttaccaaattgttatcaagcaactgataagccggcgcaatcaggaagggataatctgaaaaatcctccttctccgagatcacatcgacgggagcggcgaaggactttagcaggttgtaatacttatgtatgtgcggcatcgtccgccactggtctgtctgacgctggaactccatttcccaatagttgttcatatcgaaaagcagtccaatgcgtcgggaagccagctgtttgggcatacggcttttcttatcgtaggcggcacgaagctttttcatctcctgcgtaatacgtacatattcttcaccgcccggagaaagagtcaccccatcggtcattatcatgccgtaatggtattgctcactgcctttcagaggttgacggaaacggtaattgcacacaaacttcccaccacctgcaaaaacgtgatacacccacatacgcacagcgccgggtaagggttgagggttatacactccccagtttacttgaccgggctgtagttccatcactccgaatgttttgccgacacggttacgaaactggtcatttgaaaatccgagatcttcgggaatccccatccggaaaccttggctacctattccctgattatgtccagtcaccagatagcgggtgtaggtcaggaagtccgtatgatcgatccgtaccggatcaaccggattgaaaacaggaatcaggttggtagtgatccattggtctttgtggatatgccgccggaggatgtctgcctgcatattaacaaagcccgccaattcgtccgccataaaacggttcaggtcgagcatggcatgaggattgggcttttcaggtacctcctgctggttgggaaggcgaacctgctcgaagttctgataggtttcgctccagaaagaggtgccccatgtatcattcagtttgtcgatggtgccgtatttcttctgtaaccagacacggaattttatttgtgcattttcactgtaatccactactccgtaatgtcccggctcgttgtcaatctgccagccgataacagcagggtgattgccataacgcattgccagacgggaaacaatgttttctacataacgatggtaacggtcgctactccaggaagcatgctgacgccgtccgtgttgaatagaaactccattatcccgctgaatcagtatgtcggggtacttttttgacagccagacgggaggtgtgggagtaggagtacacataattaccttcagaccatatttctctgctaaagagacggcacgatccagccactcaaaatcatactttccttcttccggctccatcatggcccaggcgaactccgcaaaatgggtgaacttgattcccatctccgacattttcttcaaatcacgttcccattgggaggaatcccattgctcggggtaatagtaagatcctagagcaaacaactcttccggaggaaaagatttatcggccggagattgagcaaaggataccaatgaaaacaataaagctaagactaataaggactttttcatggatattattttaagtttcatcgctataataaataacaggttagcgcaatggtctggcttttattccgccggaggtcatttttacaggtttgatagtaccgtttttattaaaatacattcggtcaatgcaagtaatgcggtagttcccatcggtttcacccaaagggcggcgatgatagacaatataccattcatcctttcccggacctttgataatggaatgatgtccggcaccattagctattttagtgtcctgctccagaatctttccgactcttttgaacggaccaaaaggcgaatccgcaatggcatacgctacacaataatcgggtcctgtccagtcgccttctgaccacatgaaataatatttgccattgtgtttaagcataaaaggtccttctatataattttccggagtcacttctttataagttgttccgtcttcaaaaggtacgatactgattagatcagatcccatcttcaccatattgcaatgtccccaaccgccgtaatacatataatactgaccgtcatcgtccttgaatacaaactggtcaataggttgcgctccgttcacgatcttgccaatcagcggctttccgagcgcatccttgaaaggaccttccggacgatcggctacagccacacctatacctcccacttcactctcatgatatatgttgtttgctccaaaatagaaataatatttcccatttgcttctatcacggcaggtgcccataaagcattccttaaccagctgatattttcgacagaaaggactttcgggtgttttctccagtgtaccaaatctggggaagaaaaggcatccatgtacaattgttgttcgaaaggagctgaataagtcggataaatccagtatttatcaccgaaaacgactccttcgggatctgcataccaaccgtcaaaaaccggattagtacttgtctgttttttgcccgtatttgtttgagcaaataaggttactgaacagcaacacataatcatgaaaaagaatactattttggaattcatgtctataaatattaaagttatgccacaaaaatgatgaaaaatcaatgaaataaaggttgattatttgccaataaatagcgagaatcaaccaaattgccggaaaaataattatttcatatattgctgcttgtaaagggctgttttgatttgttttttcactttctttgtttgcaggttcaacacttttgttatatattgccgtcccattttcgttgtatctgtcttgaatttcttaattggtcatttaacaggctattatttatatatattataagtattactatgcgaattttattgtattttctccttattcttttagtgggttgctcatccggtcagaataaaaaaacacatgagcgggtagacctcgattccgtacctgtttatacgaatccgcttttgtcaagaggaggagacccatgggcggtattccataacggaatatattattatacccaaagtatgagcgaccgcatcactttatgggcaacagatgatataacccggttggcggaagcatcccagaaagatgtgtgggtacctcaaaattcgtcaaacgcatttcatctttggggacctgaaatacattacattaataataaatggtatatttattgttgtgcggatgatggaaatattgataatcgtcagatttatgtgcttgagaatgagtctgctgacccgatgaaaggggaatttgtcatgaagggaagaatatcaactgatgaagataataattgggcaattcatgccagtacttttgaacatggaggaaagcgttatttaatctggtgtggatggcagaaacgtagagtttatcaggaaaatcaatgtatttatattgccgaaatggagaacccatggacactggcttctgaccgtattttgatttccgaaccagaatatgaatgggaatgccagtggatcagtatagatggtaataaaactgcctatccgattcgtgtcaatgaagcaccgcaattcttctattctttgaagaaagataagttattgatttattattcggcaagtggtaattggactccttactactgtgtaggactgctgactgccgatactgacagcgatctgctgaatccggcttcttggaaaaaggcaccggagcctgtgtttaagcaagcaccggaaaatcatgtatatggacccggtagtatctgttttattccttcacctgacggtaaggaatggtatatgctttatcacgcccgtaagagtttgtatgatatgcttgttttggatagccggacgccgcgtatgcagaaaatagagtgggataaggaaggaatccctgttttaggaattccgcagaaagaaggattcccgcttcgcaaaccgtcaggcactcctgaacgcaaatgaaaatagggggcgtactttttgcaatacgcccgttttattcaaaaagagcccgtttctttcttttcttatttaaatggtcttctttttcacgaaaagaaaaattctcatcttttattgaatgttttttttccttttttttagtgcgtattacttatgtttgcaacgtaatctattaaataaatcaactaatgtaaaacgcgcaatgagaaatgaaaatctattgtcctttcttcttataaagagaagaattttaaaattactggctataaaatatgcatacagtttaattgttttatgcggaattagttttatggcatgttcagatgatgatcccgtaaaaaagaatccttatctgcaaacgagcacccgtgctatgctgaaagaggtagtggaagtggtgtttaacaatatcgacagtaatactgacgttactgtcgactttggtgacggaacagtcaaggaagggaaagcagctacgcctatcactcatgcttatacacaaagtggtgactacacgatgttagtgacagcgggtgagcatgcagtacagaaaaggatccgtatttacgacttattggcactgacagaagccatgaagcaattcagggatgcagataacaaaatggtatgggctatgacgcatcgctctcatacaacagacaagactattcccgaaaattcggtatctgctgtagaagctgccatcaatgcaggagcggatgtgattgaatgtgacactcatctcacaagcgatggagtagttatggtgtgccatgaccagacaatcaatgctacgactaacggcacaggggatattacgaaaatgacttatgctgaaattcagcaatataatctgttggaccggaatggaagggtgaccgatgagaagatgcccacattggaagagtttctgaaagcagggcgtggaaaaatatatttcaatctggattattctccacgtacagcctctacccaagaagtgatgaatgttgtcaaggaactggatatgatggaacaagtctttttctattgtaacagtagccagaaagcagaagaagtgttgtctatttctaaaaaggcacacgtgtacacatgggcacaaagcgcttacaaacctctggttgggcttccgggcaattacttcgtgcaatattcttatgctcccgacgggcaaagtactcctataggaactgccgtcagtgagggaatgattcctacagtcaatatgcttcatgtattatccggattgatacctgaatatgatataaatacgacttatctggatgagcttcttcagatttatcctgaagtacgtatgatacagacagatgcaccggaagtattaatctccgctttacaagcaagaggattgcgttaactttatcatctaacataaaatcatttatttatgaagaatattcatttcaaaacgtgtacctgtctgttaggtatgctgctgatactgttttccggtatacaggtaaagggagcttctttggaagttcagcaggaaagtaagatatcaggtacggtgacggacgaaaagggcgaaccagttattggcgcttccgtagtagtcgtagaatcgaaacagggtactattacagatatagacggtaaatttctggtgaacgtacctaagaatggacacctgaaagtgtcttatatcggttatgaaacacaagaagtggctgttaaaaaccgccagttattgaagatcgtattgaaagaagaatcgaccgctttgaatgaagtggtagtggtgggttacggtacgatgaaacggaaagaaatgacttcggctatttcgcatataggtgcgaaagatctgaatcagatatccagcctcgatgcctccatgcttttgcaggggaaagtttccagcgtttcggtttctaacacagctctggccgatccgaacaatcaaggaagtattcagattcgtggtgtctcttcccgtaatgcaggtttaggaccgttaattgtggtagacggagtgccgggaggtgatatgacgaatattaaccctgccgatattgaatcgattgatgtattgaaagacggtgctgcttctgcgatctatggtacgcggggtagtaacggggttatcctgattaatctaaagaaagggaccaaagatggacaggttcatacaacctatagtacttccgttacttttaataaagctaaaaaagaactcgacataatgaatgcggaagaataccgtgcttatcgcacagtgtctaatccgctttccgatatgggagctgattcagactggtttgatgccgttactcaattgggggtgactcacatgcatacattgacattttccggcggtaatgcgagaaccaactatcgggtgaccgccgactatcgtaatgcccgtggtattgatttgcgttccgaccgtcgtgaatatggagcacgtgccaatattaaccatacaaccaaagacgggctattcacgttctctgctaatataactcctcgtgttatcgaccggaacaaatcagccaatgtatatagcaatgctattaaaaacaatccgacaatgcctatttatgattcggaatcggctaatgggtactatcgttttcccagtggaacggaaggttctaatatcgtagagcaattgaatgaagaagagaatggtacggaaattaagttgctggaatggaatgctacggctgccgttaatctgctgcctctgtttaatccgaagaatccggacatggtattgaagtcgcaggtcactatttctcaatatcaagttgataaatttaacggatggtttacaccgtctacttatggttctaacgtaaatgatggtgtcaccggaaaagccagccgtgacttcgacaaaagtacgactaacaatctggaatgggtaacaaatttctctacacgtatcaagaatcatcagatccgtgcaatggtggggtatagctataattatggtgtaaattccggaatgtctgctgaaaactggaatttctcttcggatggattgacgtataataatctgggttccgggctggaagcggcaaaagatggaaaaacaatgatgggctcctataagaatgaccataagttaatcagcttcttcggacgtgttaattatgattggaaagagcgctacctgtttactttctctttacgccacgaagggtcttcccgctttggcgagaatcataaatggggcaattttccggctgtatctgtcggttggcgtatctcggatgagaagtttatgaaaggactttcatggattgatgacttgaaagtacgttatgattatggggtgacaggtaatcaggaaataggaaattataattctctggctacttaccgggctttcggttggtatcaatacaatggtaaccgttttcatgtatggggaccgagcaaaaatacgaactcggaattgcgctgggagaagggacataatcagaatgtgggtttggacttctcactcttctcacacaaagtgaccggttcatttaactatttccatcgtaaacaaagtgatttgctcggagattattctgtaccggtaccacctaacttgttctccaccatctataccaatgtaggtacattgcgtaataccggtttcgaacttgatgttacagtaaatgctgtccggacaaaggatttcacttatagtttcacattagtgggggctactaataacaataagtttgtcagtttttccaacgatatatataaaggacaaaaatattactctacctgtagcatggcgaatccgaataatccgggatatttgcagcggattgaagagggggaacgtattggtaactactttacatatcgttatgcaggagtggataaaaaaggtgactggctgatttatgataaaaaggggaatgtgattcctgtagcccaaggtacggaagaggataagtctgtgaccggaaacggtttgccgaaattcaccggctctatgacgcataacttcacttataagaactttgatttgtctgttgccctccgtggtgctgccgggtttgacatattcaacgtgcatgatttctatttcggattgcagagcatgactaccaaccagttgacgaccgcttattcgaagaatgcacatatcacgacaggtaagaatgtgattaccgactacttcattgaaccgggtgattatctgaagatagacaacgtcactttaggatataccatgaacctgaataagaaatatattgaaaagatacgtttgttcggtacggccaacaatctttatacgtttacgaagtttaccggtgtagatccttctacctacgaagtgaacggactgacaccgggtactttcggaggaggatataactattatccgtctgcttttcagtttattttaggattacaagtaagtttctaataaaagacgattatgaaaataacaaaatatatcattggattagggataatggcaggtacagtcattagtttgccatcctgtacagatctgtcggaaacggtgtatgatcaggtcatgtctcaaaactattataataccaaacaggatgttatcaacgccgtttttcgtccgtttgagcatatctatgaatccattgtcagacgtcatgaacacgaagaactgacaggggatcagttgataacgcctactcggggaacttggtggtatgatggcggtaaatgggaaaaatatcattatcatcaatacgatgacattaatcaggaagactggacaaacgagtgggaaggcatgtatggcggtatcggtcaatgcaatctggtgttggatgatttgtctcaattgaatccttctaaatttaatttaagtgacagtgagtttgatagttttaaagcgcaactacgttgtatgagagcttattgttatcttcgcctgcttaatagttaccgtaattgtatcttaactacgacttctgaccaagcggtcaatgaacagccggaaaaccggaagcaggtatctccacaggttatgtttgattttatcgaaagtgagttgagagatgtctgtctggtagctttaccttccaaaatcggacaatctggtaatggcggtcaacaaggacaatttaccaaggcgggagctgctgcattgctggtacgtctttatttgaatgcggaaaagtggattggacagcccaaatggcaggaatgtatcgatatgtgtgagcgtatcaccggaggagaattcggttattatgcaatcgctaataactggtacgaaccttttgactggaataatgaaatgtgtaatgaagtaattctcggttttcccggttcttatggattgactagctggcatctgcaaaatgacaagagaactgtttacggacgggcccttccttatggttgtgagaaatacctgaaaattgaaggaaatggcagccgaaatcccaaatatgcactttcgccaagttataataaccagcaaccacgtgcattgtttgattatgaattgggcatggttacgcagaaattcgccaaatatgcaggcgataaacgttataaacaatatgtaaatacgagtaataatacacgggaaggtatgttcttcatggaagggaaaatagctaattccagtattagtgggggatatgccaagaatccggataatcaatatgtcctttacctacttgatcaagtgggacgttttgaaggtaacgcagaatccggttatattgctaacccgaattatcaggagtctaaactgggaaacggagatttcaactcggggctttactgtgtgaagtatcctttctatccgtttgatggaggatattttatagagtcggattatacggaaatccgtttggcggagattatttattcgcaggcggaatgccttcttcgtctcggacaggcaggcgaggccggcaagctgttgaacagcgtgcgtaaacgcaactatgaaaactttactgcagatatcgcttatcagccggaaggtaacgtggtacttgatctaaaagaaatgcttgatgaatgggggcgggaatttcttgcggagagccgtcgtcgtacggatttgatccgcttcggaagatttcaggatgcatggtgggacaagaaacgggatgcagatactcattatgaattgttcccgttttcacagacccaattggagcagaatgaatatctgaaacagaatcccggttatccggatattgcccgttaagcggtgaactgtaattatttcaatttagtgtacaagtttaaaatgaagaaaaatgaaaaataagttgctcacaatatcaaagattgggcttttggccttcactattttagtgagccaggcgtgtcaggaagattatgagatggttgatcctccgatgattactgattatgatgatgatctggatgaagaagttgtcttgcaaaaaggactggaaagttattttgtaactcaattcggtgaaggggacatggatggtacttcatgggatcaggcaatggatgtagctggttttcgcaaattattgagtggatctatcgatctgtccaagagtactatttacatgagccagggaaaatatgtgatgtccgagaccggaggactcggggtgattatccgcaaagacattaaagcgatcaaaggaggatatagtttgttgagcgaagggacagatctgactaatcgtcgtattgatacgtataagacagtgatcagcggagatgtaaacggtaataatcaggctgattccggtgattgcggactattgttggtgaaaggagggattattgggattgaaggagttacttttcaatatgggtacctttctaataatgatgccaagtctaacgagtgtggtagcggaatttatatcaatggtaacgtcaatagcacctctgtcgaattaacggattgtattatcagggattgtaaaacggaagctgtcaacgggcaaggaggagtagcgggaggtacagctattcttattgcttccgggagctcaaaactgaacaatgtgaagttcctggataatgcggcggatagccgtggcggagcaatacggtgtaacagcaataaggctgttgtgtttatgaataattgcctgataactggcaattcagtaagagaactttttggggtcggtattcagatatcatcgggacatatttgtatgaataacacaaccattgtcggaaatccgggaaaaggtgctgctttaaacgggggaggtagtttcatgctcgctaatagtacgattgtagggcatgatattgatcaggagtatggcgcctttcgatgtgaaacctctattgatggtgatactaagtttattaataacctgttgatttccgagaattctaccgctccaagcttcattttgaacggagcgaataaagaagcttactccatgggatataacttgtatcagcgagttaataatttcacaatgggcgtttctgatactgcttatcctacccttgtgaatggcaacctgacggaagagggtgtttataagtggaatattgaccagatcggacaggtgggtggttatgctaccaaacaagctgtaatcaatgctgtgaaaagtttcaatcctgctgcttctcctatggttaatttaggtgaggtattcgtggaatggatgggtgaagatgctttcggattggatcagcgtggcgtgacacgcaatcctgataagatgcaaatgggagcttatgatgctgtattgtccaactgaatctttaaaaagtaattgtgatatgaaaaacaaattttatataatgaccgctttggtcattagtctgacaggctgttcaaacattgaagacgggacgcagccgaccggcaactttcccgaagatcatataatccgtgttgtaacagaagtgaaggctcctgtgtcgcgtgccggatatgatgcaagtaatctggagagttttggactgatcattcataacagtgaaaacattgcttatgattataattcgcaaatggtaaaatctaataatgactggaatacggcggacgggcaacaaatgctttgggataatgcaagaactccggtaacagtagtggcgtatgctccttacatttcggaagctagtttagacactccgttagctatcaacatacaaagcaaccaaactactgaagaaaatgtgattgcttctgatttcctgttgactaaatcaatggttgatccgaaacaggatctcaccgcagatggtagattgaaagttactttggatcatgccatgagcaagctgattataaaagtgacggtaaataatggtatggaagatgcggcgatcagtaaattgggcgatatggctgtaaatggtacaatagtgggtggtatttgtgatttgtcagtgccggaaccggtagtcattccacgggaagatgctgtagctacaactatcgccccttataagggtacggatgggtatgaatgtattcttctcccgcaaacaataatagaaggcttttctgtcaatttcagttatgacggaaaattgtatatatggactgccgaagagcccattgagttgcaaaagggagtagagcatacgctgacactgaatgtaaatgaaacggcacggttggctaccatgcaaatgaaatatcgggcaaccggtcagattatctatcagaaataaaaaggaggagatgagttatgaaaattactaaacatatattggctgcatgtatattaacgggtatggtagcttgtgatacggataaagagatagccgtgttcaatgaagactccggtgcaatcaagatcaatgctgttattgatgctgcatatacccgtagtaatcctacaggaacaaatgaacagcaaatgcaatttaataatggagaccagattctgttgagttgcgaagatggtagtgtgacttatatgttgtctggagggcaatgggctcctacggataactattatcttaggtggggaaatgaacctgttacttattctgccttttatccggtgactgaaggaacaagcgtagccaacttctctcttcctattaatcagcagagtttggaaaatctggcgagcgcagactacatgacttgcacagtagaagatgctataaatgagggatcaggtgtccttcatctgaatatgaaccggagaatggcgaaagttatcatgacattggacgatatagactcacaaagtaaagctctaggagttaaaatcggttcctatcagggatatacggacggaaatgtttcatcgggaactgcacttgtttcaccgtatgtcaccattcctgaaggagggaaagccggacaaagcggatgtaaatatacggcgatcgtagctccgggagctgcaaatcctaatagtactttcgtttctttaaattacaaaggggaagatctggtattgccgggcattcctgcaataaaggccggattttgttatgaatttactttgaaagtagaaggttcggtcattagattgagtgaaccgattgtcactccatgggagactggtacaatcaatgggggagatgcaacggaattgcaattggacgcttattatgtgaaagagcatgctacagggaatgctaccggtatggattgggataatgcaatgggagtagacgggttacgcaatctattgagaactaacactaacagtgcgatcacgactgcgaatgctaagaaattggatggtaagaatatctatgtggcaggcggtacctatttgatagcagatcaggaagccggtctgaaaatagagtatagcggatatagcaaacaagtcgaaataaaggttgtgtgtggatatgatcctcaaagtacccggaaggatttaagcaagcgtgatcctgtccggtatctgactactttcacaggagatgcaaataataacggcattgcggatgcgggtgattattccttgtttacattaggaaaccagatagatattacatttgaaggttgtacgttctcttgcggttatcatcccaatgagaaaataaatggctatagcggtggattcctgattgcgaatggtagcagtggcaatgcaacattacagttgaatcattgtatcattgaaaagtgctataatgcgggagtaaatggttcaggtgaggctggtggttccggtatattcatgtataaggggacagccaaactaaatcatgtgcagttgagaaacaacaaggcatcttcgcgtggaggcgcaattcgcgtcaatgacagtgggagtattctttttatgaataattgctccattacaggcaatgaaggcggacagttcggttatgctattcaaatgtcaaacggtcatttatgtatgaataatacaactgttaccaataatagtggtagagatggaaccattaacggcgcggggagtatgttgattgtaaactctaccattatcgaggatggtgctcaaaatagcggggctgttattcgttgtgaatcctggccggcccggcaatcattcttgatgaataatatcatcctgaataaaaatgcagctaatccggttgttgaaatgtccggtgatgatactcgccatttgacatccaaagggtataatctgatgggcggtacgatcatgcctgcatcaaccaacaagtttacaacatcagagtttgataagtataacagtacgattagctctttaaatgtcgtatgggatgccaatcgttctgtctatacttgggacgggaatgtgaatgagtttacccggactgcttccgacgctgttaagaatgcgatcacaaccggctttaaaccggatagttgtcctttccagaatttaggtgaggagtttggaaaatggttggaagagatggatgctttttccactgaccagttggggaatccgcgtgataaaaatgcgatgtggccgggagcttatcaagaataatgatacaatttatttaaacgaatgacaatgaaaaactacaaactgatatggttagggatattctgttgtttgcaacctcttatattgtttgcacaacggggagaaacgatccgtaaggcatttttagatccgaagtccgatcaggtgttagtcgtggcacaccgggggaactggcggagtgcaccggaaaattccgtagcggcaattgatagtgccatacaaatgggagtggatattgtggagattgatattcacaagactaaagacggacaattaatattgatgcacgatgaccgtgtagaccggacaaccaatggtaaaggattgattaaggattatacattggcagaaatcaagaagttgaaactgaaagataaggatggaaatctgacagaacatattgttccaacattggaagaggcattgttggcaggcaaaggtcagattatgtttaacttggataaggcgtattctgtgtttgacgaggtatacgctgtgctcgagaaaaccggaactgccagtttggtgataatgaaaggaggccagccggtggaaactgtcaaaagtgagtttggagattatctggataaagtgatttacataccggtgataggacttgacggaaaggatggcgaaaagaaggtcagggactatatgacacagctgcatcctgctgccttcgaattggtttattcggattcttccagtcctttgcctcgaaaagtgaaatcgattattctgggaaagagtcggatttggtacaatacgttgtgggcttctcttgcgggagggcatgaagacgatcaggctttaaaagatccggatggaaactatggatatctgattgaagagctaggggcacggattctccagactgatcgtccgggattcatgctggattatttgagaaaaaagggattgcatgattaatcgtctgaagacaatgaggtaaaatgtattgtttggcacacagataacgtcgatgatataaacagacgttatctgtgttgcttttatctattctccaagtgaaaataaatttgagatttggcttaggttactaaaatagctatatttggctcactgaatcgacatgagtatataatatgaaaaagtcaataatagcatttatcagtcttattactctttgtattgagccattaatggcatctgccgagttttcctttaagaaatatcaggtagagaacggactgtctcataacacaacctggtgtgcaattcaagatagttatggctttttatggatagggacaagtaacgggctgaactgctattatggtagcggaaataagatttatcggaatgttttaaatgacaaatattctttagggaacaactttgtcagttctctgatggaagagggtgaagacctttggataggaacaagttccggactatacatttatgatcgctctgacgatcatttcttgtattttgataagacaaccaaatatggagtgtttattagttgcgaagtcaagaaaattgtaaaaacgaaaaatggcttgatctggatcgctaccttggggcaaggcatctttatttatgatccggcaaaagatgttttgactcaaaatagtattcggactttttttgcttgggatatttgccagggtacggattctcttgtctatgtttcttctatgcaggaggggttactttgctttgatgaagagggaacttttctgcagaactatccggtttcatccgaattgagtattggcaatcaaaggattaactgtctccatagtattgaacatgagatttggtgtggcgtggggacgaattcgttagggtgttatcaggaaggaagtcgggaattaaaaatatatgatacatctgcagagagtttcagttctattctttgtctgatggactatagcgagaaagaaatgctggttggtacggacaatggcgtttatttgtttgaccgtgagcgtaaaacatttcgtaggggagactctccgtttggtttatggactttgagtgatccgactgtacacgcgatgatgtgggataatgaaggcacgctttgggtaatgactaattccggcggaataaattatatgtctaaacagtcgaagcgtttttctacttattccctgtctttgacggggatggaaaaagcagatagggggataggacctttctgtgaagatcgggagaagaatgtttgggtgggaacccggaatggattgtggtttttcaattcacaaactcattctttttatgagtattctttgaagaaatcgaatataagatacgatgtacgtagcttgttgttggagggcgataatctttgggtgggaacttatgctgaaggattgcatgtattgaatctgaaaaccgggaatattaaaagttatacttattcccgtaatatcccgaatacgctttgcagtaatgatgtactaagcctttttaaagaccgtaaaggagaaatctttatcggaacaagctggggattatgtcgctataatccgcaatcggataattttataactgtgattaatgtcggtgctatggcttctgtaactgatatctatgaggatatgtacaataatctttggattgcgacctcaaatcgtggcgttttctgttataatacagttggtgaagagtggaagcattttgaacatatccgggaggacctgactactattacgagtaactctgtgataacattatttgaagataggaaaggtacgatgtggtttgggaccaatggtggaggattatgctctttttccaaagaaacagaaacttttgttgattttgatccggaaaatgtctggttgccggataaggttatttattcgatagagcaggatcaggcaggtaatttttggatttcctgtaattccgggttatatcagtttaatccgataaataagaatgagaaccggctttttactataaatgacggtttgcagggaaatcagttcacggcgcaatcttcattggcctcatcgacggggaagttgtattttggaggagtgaacggctttaatgtttttgaaccgaaagaatttgcagataacacctaccttcctcctgtttatgttatggatatcagttttcctaatttgaataatgagcgggaagtgaggcggctgctccagctggataagcctttttatacagttgataagataagattaccttataagaataacagtcttaccatccgttttgcgacacttagctatgaagatcctcttagaaaccgttatgcgtatattttgaacggagtagataaggaatggattaacaactcttctaataatacggcttcctataccaatcttcctccgggggagtatgagtttttggttcgtggttcgaataatgaccattattggaatgaaaaggcaatttctttatggattgtggttactcctccctggtggcggactactattgcttatgtcgtatatgcattgttattacttgccgtcatcgtatttcttggttggcgttggaatttgtatgtcaggcgtaagtataaacgtcggatggaggagtatcagactaccaaagaaaaagaaatgtataaatcgaaaatcaatttttttattaatcttgtacatgaaatacgtactccgctaagtttgattcgtttgccgttggagaaattgagagaagaggaaatcaaagggaaagagaacaagtatatttctgtgatagaaaagaatgtagattatctattgggaatcatcaatcagttacttgattttcagaagttggaaagtagtgctttgcagttgaatttgaggaaatgcaatgttaatgcattggtaagtgatatttttaatcaattcagcggttctgcggagttgagaggactgacattacatctttgcttgcctcgtgaagaaattaatgcgatgattgattcggagaagataagtaagattctcgtaaatctgatgggaaatgcgatgaaatatgcgaaatccaggatggaattgaaagtattatcagtagatgacgaggtgaggatagcggttactgatgatggccccggcatcccggaggaccaacacgataaaatatttcaagctttttatcaattgcctgacgacccggtggcatcatctaagggtaccggaattggtttggcatttgcaagatccttggcagaagcccatcatgggaatttgtttctggaaaataattccgaggagggggcttcatttgtgttatctttaccattgggagttgtagaaacggaagatgcatctgatggattgactgaaacggatgttgtaggtgttggagaagaagtgacttctgtttctgaattcggtaataggaaattcacagttttattggtggaggataatattgaattgttaaatttaactcgagaagctttaagtgtttggttcaaggtgatacgtgccggtaatggaaaagaagcactggaaatacttgcacaccagggtgtagatgttattgtcagtgatattatgatgcctgaaatggatggacttgaactttgtaatcatgtaaaatccgatatggcttattctcatattcctgttgttttgctgactgcaaaaacgacattggaatctaaagtggaaggacttgaaagtggtgctgatgtatatctagagaaaccgttttctattaagcagctccataaacagatcgagaatttattaaaactgcgattggcgtttcataaacagatgacggacatcacaattggttcatcctcttcactttcggattttgccatttctcaaaaagatgtagaatttatagacaagatcaatgcaattttattggagcaggttgttaatgaaaattattcaattgaaacattggcagatcaaatgaatatgagtcattctaatctttaccggaagatgaaaagtttgtttggtatgcctcctaataactatgttaagaatttccgcttaaacaaagcagctgaattaatagcaaatggtgttcgaatagctgaagctgcagaacggttaggctttgcttcttcttcccattttgcaaaatgttttaaagagaaattcggaatgttgccaaaagattatagataacaagtcttttcatgatgggaaaaataaggggagggtaaatgaagtttaaaaatactagaaatatactgtagtaagattttttatccattcgttttatattcttaactccgaaaaattcgtaagtgtagataaaccaactacttttggctctcgaatttgcagcatttttggatgtcttgcgtctaataaacataaactaatatattctagtcatgaaacacagactgttactactaattctattcgtatttgctatctccgtggcggggtgggcacaatccacagctccttcttatacagtcaaaggagtacttattgattctttaacacaagagggagaaccgtatgctaccatcaaaatagcaaagaaaaatgctccggataaagcagtcaagatggcggtgactggggcgaatggtaaatttcaggagaaactgaatgtcgctgcgggcaattacatcatcactatttcttcgattggtaaagcgccgatagtaaaggaatttactctaaaaccgtccgtgaaggaggttgacttgggcacaatgatttcttcagaggccaataacgtattgaaaggagtggaggtagttgcacaaaaacctttggtaaaggtagatgtggataagattgaatataatattgaagatgacccggactcaaaatcgaacagtatattggagatgcttcggaaagtgcctttggtaacggtggatggagaagacaatgtacaggtgaacggcagtagcagtttcaagatacatgtaaatggaaagcccaataatatgatgagtaataatccgaaggaagttctgaaaagtatgccggcaaacacgatcaaatatattgaggtgataacttcaccgggagctaaatatgatgcggaaggtatcggaggtattctgaatatcgtcacagtaggttccggatttgaaggatacacggctactttcagaggaaatgctaataataacggagtaggtgccggcacttacgcaatggtgaaacaaggtaaactgactgtttctgccaactataactacaattataataatagcccgcgcagctattccgacagttatcgcgaaaactacgaaccggataaagagaatgaaaaatatctggaatcggaaagtagctccaagtcgaaagggaatttccaatatggcaatttggaagccagttacgagattgatacgttgaggctgctgaccgtggctttcggaatgtacggtagcagtgacaaaagtaacagtggcggaaatacgattatgcacggagctgaccgacagaattttgcgtaccgttatagaaccgacaatcatggaaaagggtcatggtattctatcaacggaaatatagactatcagcgtacttcccgaaagaataaagaacgaatgattacgctttcttataaaatcaattcccaaccccaaacgaatgattcatataatacttatctggatatcgagcctgatgagaataaactggatatcatcaaagaattgtcattaaagaatttccattcggacggaaagacaaatacgatggagcagactttccaggtggactatactactccgattggaaagctgcatacaattgaaaccggtgccaaatatattttccgacgtaactccagtgataatcggttttatgaagccgagggagcaagtgaaaactatgcatataatgagaatcgtagtagcgagtaccgtcatttgaatcatattctctctgcttatgccggatatacgctgaaatacaagggatttactttcaaaccgggattgcgttatgagcaaaccatacaagaggtgaagtatctggtgggtccgggcgagaactttgattcgaattttagtgatctggttccttccgtttccttgggaataaaactaggaaagacgcagaatttgcgtggtggatataatatgcgtatctggcgtccgggtatctggaatttgaatccttatttcgataatcagaatccgatgtttatcagtcagggaaatccgaacttgaagagtgagaagagtcattcgttcgacttgtcttacagcagttttacgtccaagttcaacatcaatctttctttgcgtcattctttcaataacaacggaattgaaagaatcagccgcttgattactgataaagacggagaaatctttgaaggcgggcataaagctccctacggtgcactgtatagcacatacggtaatatcggaaagagccgggaaacaggattgaacttttatttgaactggaatgcttctcctaaaacgagaatttacgtcaatggacgtggcaattatagcgatttgcggagtcctgcccaagagctgcacaattatggatggaatgcttctgcttatggaggaattcagcagaccttaccgggaaaagttcgtttgagcctgaacggcggaggtagcacaccccgaatcagtttgcagggaaaaggttcaggatatagttattatagtttgggattgagccgttctttcctgaaagaagaacgtctttctttgaatatttattgcagcaatgttctggagaaatacagaacttacaataatcacacagaaggagctaactttatttcgaagagttcgagcaaatatccgagccggtattacggtttcagtatcagctatcggcttggagagttgaaagccagtgtgaagaaagccgcacgaagcatcgacaatgacgatgtgaaaggtggcggcggcggaggtggaaacaccggtggtggaggtggccagtagaccacttccgcacaccgagattccctcttatttctgtctcacgtcttgcttgttggtgttaaaaccaagtttggttaatccggcttgtacgtcgggatggctcatgaagagtttccacaataatccgctccggtagttttcgatcatgacagcaataggaccctggtcgatagccagataacgttgcggataccaattgtccgtttcgctgaaagcatcgtagaatccgaaaggaccgaacactttatctctcatactatatagatggcgcatcacttgcatggaatattccggtgtatagacaatggatgaaagcgcggcggtaggggagattactcctttgtcctcctgctcattgggcgaatgagccgcatatccatcgacggagtagctggcagtcagtccccaacaatccggtccgaaacctttgtaatgtttagggttgcggatgcagtaagcacggttgactagtgtcaggttgcgcatttcgtggaagtagctggggcagtattcatctttcagtcccactgggtcaagtccgaggaaagagtattgagcccagaaaagcggtccggcttcggtgccctgatagcggaggtgcaactcgattccttccactttatgcggagaaacgatggctccgttctgtgcccaaccgtcatgatagacagccgcaggtactccatgggtaggagaagcggcggcaagaatatacataatcatacattcgttgtagccgtgtacagggaaattcatttcccagccatacgtcggactccaatgccagtaaagaacgttttgcccgccttgccgataccagttccagtcgacatcccgccaaatctggtcgatccgttgggcgagggctttctctttctcgtttccgttgacgtaatattggtgtacggccagcagcccttggatgaggaaagcggtctctaccagatcgcccccattatctttctggccgaatggtttcactttgcccgtatcaccataccaccaatgagggtaggctccgtggaaacggtctgccttttcgaggaaagaaacgatgcgttccattcgtgccagtccctcttcgcgggtgacgtaaccgcggtcgattcccgcaaggatagccatgatgccgaaaccgctgccgccggaagtgactacgttggcatcgttttctggataaacgccgtccacatgataacgttcgggagctaagccgctattcggctcggcaccttcccagaaatagaggaaagtccgtcgctggacggtatccatcagggcgtcgtccgataacgagtcggtggctgtggaaaggttgttgcttttgcttttccctttacagctctggaaagtcagggcaacggcggatagaaatagtaacatgagcggaagtgcactcatttctattattcttttatatttatcgttcataatcaaggtgataaaagtttagtttaacgtgaacttcgcggttttcacatcacggctgttcgtaccgatcatcacttcaaagtcgcccggttcggcaaccagttgcaagtcataattatagtatcgaagcatttccggagcaatcttgaaacggacaatcttcatttctcccggttccaggaatatcttttggaaacctttcagctctttgacgggacgggtactgctacccacaacgtcgcggatataaagctgtaccacttccgagccgggccatgttccggtattggtaacctccactgccgcggtcaacgaaccgttcatgtccatggaagaatgactcaagtcgatgtcgctgtaagagaacgtcgtataagaaaggccgtaaccgaacggataaagcggatcattatccacatcgagatagttgctgcggaatttctcgaaccatttgccatctttcaatgggcgtccggtatttttgtgcgcataataaagaggtatctggccgacattcttcgggaaagtcatagtcagtttaccacccggattgacgtaaccgaagagggcgtcaccaatggcgtaagcggcttcactacctccgaaccatacattcagaatggcaggcacatgctcctgttcccagttcagcgtaagcggacgtccggtgaataacaccagtaccaccggtttgcctgtctttaaaagttctttcaacagattctgttgtacgtcgggaatattcaagtctgtacgactgctgctttcaccgctcatttcagaagattcgcctagcgctgcgatgatgatatccgaccgacgggctacgttcaatgcttcgtccaacaactgctggtcggtgcggttgtcacggttcagggaacggccgaacatcgttgcccgttcttcgtaacttgcgtcactaatcaggttgcttcctttagcgtacatgatattcgcttttccggctgtcatctctttcaatccttctaccaaagaagggcaacggtcgagcacagctgctacgctccatgtacccggcatattgctacggctgtttgccaacggaccgataactgcaatatttccttttgggttgaaaggcaacaacggatttccgttcggattaccgtcgggactgtcattcttcagaagaacgaaactttctgctgcaattctgcgggctgcatcacgatgggctttggtaaagatgtcgcgtgccggacgtttcggatcgcaatatttataaggattatcaaacaatcccagtttatatttggcttccagaatacgacggcaagccgtattcaatgtttccatagagacttttccttcctgaacggatttcttcagtgtccctacaaaaccctcgcttaccatatccatatccactccggcgttgatggcacgggcggatactgtctgaagatcaccgataccgtgatcgatcatttctgaaatgcccgtataatcagttaccacaaaaccgttgaatccccactgtccgcggagaatatccgtcatcagccatttattggcagtggccggaataccgtctacttcattaaaagaagccatcacgctacctacacccgcttcaacggctgcttcatacggcagcatataatcattgaacattcgttggcggctcatatccacggtgttatagtcgcggccggcttcgcctgccccatataacgcaaagtgttttacgcaggccatgatttcgtcattccgttccatgtttttcccctgatagccgcgtaccatcgcttcggcaatcatggcaccgagaaacgggtcttcgccactaccttcggatacgcgtccccaacgagggtcgcgtgaaatatccaccatcgggctgaaggtccatgagattccatcggcacttgcctctacggctgcaatgcgggcagactcttcaatggctgtcatgtcccaggtgcaagacaaaccgagcgggatagggaacatcgtttcgtatccgtgaataacgtccatcccgaacaataacggaatacccagccgggaatcttccacagcctgtttctgtacttcacgtattttctctactcctttcagattgaacaatcctcccacttcgcctttcttgatttttgcggcgatgtcgctgcttttagcttgtcccgtagtgatctctccggtgacgggaaggtttaactgtccgattttttcttccagcgtcattttattcatcaatacgtcgatgaaacgatccatatcctgtggcgacttttgtgccgacgtggttagaaaacctgcagcaaacaacaggacggatagacttaactttttgtatatcatattattatagttaattttatctctattcatataaagtcctcctgatgcgttgaatgttcggcaccgaggaggacattgttcgacaccgaggaacagtagtttcggcaccgaggaaacaaccgttcggcaccgaggaactttcttattggtagtcggggttctgtactaacactcccttagacttgtcgatctctgtctgcggcagtggaagcagtgcgtttttgtcctgataattggttttaccggctgcgtgcaacacttcttttgcaatgccccaacgaacgaggtcatagaaacggtcgaattccaaccctaattccacacggcgttcgtggcggatggcctcacgcaattctccctgatcggtagtcgtcactttaggcaatatattgctgttggtgcctctggcgcgtgcgcgtacttgttccaaatagtcgattgcttcacccggaatacctttttcattagctgattcggctcccatcagcagtacatctgcgtagcggatcagacgaatgtttacccagaatcctttgttggtatattctttacgcaaagccgggtcggtataggctttcttgttaaagtaagcacctattgccggagaaaccggagattcaccgtatggctcgttggtattttccggagtgataggatcgctgtccgagtggcggaagtagagtagggtggagtttttgcgtggatcaccctgttcgtatgcttccgccatatactctgttgccatgtgccatccccagcccaagtcccattgacctgctccgcgtacgccttgtacttcacagaactggctaccgataacggtactttgaggaagagcggcagtagctgtacattgcaactcgaatatggaacctccgttattttcaccatcatccgtgaaaatctcattatacggagtctttaagttgtagagcccctttttgatgacatcggtggaggctgtgtacatattgttccagtcgttgcgcatcatataagtacgcgcgtgtaaggaacgggcagctccccaagtcagtcgtccggtgtattcgctgctccatgtttccggcaatgactcttctgctgttttcaggtccttgtcgatttgctcatagattttatcagcacttgtcttcgggatattggcttccgaagcatcgttgattttataagtcaccaaaggaacttcgccgaaagctcttaccagattgaagtagcaataagcacggaagaaagaggcctctcccttattgatgatgtcttcagtttctgtttgtccggctgtttctttttctgcaatggcatcaagaatctcattacattggtagatgatggcataattctgtccccaataagcacccagtaggccgttggtcggtgtatacacaaaatcatcatacatttcggctacatcagagccatcgctggcaatacttcctttttccgaatcttccgaacgaaaacagtggatggcaaaagcaggagggccggctgtcacattatagttacgcatcatcgtatagacattataaatcttaccgttgaccagagcgttcggattgtcatcttccgtgaactgtccttgcggactacgatccagaaagtcactacagctacctagaaataatgtagttgaagtaataagggttgcaaatatatatttattcagtttcatataatgatagttttaaagattaaagttgtgttccgcatggaaaactggcagtggcaccttgtcactagaatgttaggttaatgccgaaggtgtagactgcaggtacaggataactaccgttatctactccgaatgcggtggcagttcctccaagttcgggagtatatccggtgttatgtttccatgtcttcaggttctgtatgttgacatagactttcagagcttgcagacgtattttggcaattaagctcttgtcgaacgtatacgctaactgtacattacggatacggaagaaactaccgttctcaatgtaatagtcggaattcaagttattgatagaatgtttggtgttcagcaacggttgggtgttggacgtaccttctccgtgccagcggtccaaacgttgttccaggtagttgaactgggcaaaattgtagttatcccatgtacggaaaatcttgtttccgccttgtcccatcatgtcgatgcctaacgaccaattcttgtagtctactccgagagaaaaaccgtaagtgacctttggagtcgggttgcctatcatggtacggtcttccggggtgatttctccgtcaccgttcacatcggcgaatttcaggtcaccgggggtaacggtagccagtgtatttttgggtgatgcgtcaatatccgcttgtgactgataaacgcctgccactttgtaaccgtagaaatatccgataggataacctgccattgtgtaactttgctgcttatctccggcaatgatggaatatccttcctgaacaagactttttacctcattcttgatagtagtcaggttggcactgacggaatatccccaatcaccaatctgatcgcgccaggttacagccatttccactcctttattctgaatctctcccaagtttccgataccggggatagttccggaaattccgggaacttcggctaacaaatctttggtattcttcttgtagtaaacaccctcaaaatgcaagcggttgcgaagcaggttcgtttcaaatccggcttcccaggcttctactttttcccaacgcaggttaggattaggaagataggcaagctggtatccgggataaatgatggacggtttaccgaatacggccgaataagcattggtcaataagggttcggcaggataggctttatccaggttctggtttcctaacgtaccgtaagatgctttgattttcaacatatccagccatttgatgtctttcataaattcttcttcggacatcaaccaacctccacccagcgagaagaagttctgccattcatttcctgtataggagaaagcggaagaaccatcccggcggaaagaaccgttgaacaagtatttgcctttatagttgtagatcacgcgtgcaagtacggataatgtactgcgttcccattgagtacttccattggtagcggtagctgcatcgccgatgctgacaaaccatttgtccggattatccggaataaccagtccgaccccctgcttgcgtgctccgtccaatcggctcaacgaattataataggtagtaaaaccggcggtagctgtcaggttatgatttccattatcaaagctgttggtgtatgtcaacaggtagtcgctctgaactttggtttcattctctttaaactggctgacctcggtcttgcctgttcccaaagtagagatccctccgttgacagtggcatcgtatacttttacgatcggtgtatacgtccgtccgttgttcgacgcataatccatggagaacatcgctttgaacgtgaaatgtttcaggaagtctacctcaccataaatattaccggatgcccggtagttctccgctttggtagtattcgctttcaattcgacgtctaccatcgggttgttgatctgcgctttctggaattcgggcagagccgtatataatccgtattcgttgttatacaccggagcgataggagttgcacgcagggcattcaatacctgtttggaatcagcaggaagcatacgtgcaccgttgaattggaaaccgactttcaaaaagtccgtaatcttataatcattacttgcgttgatggttaccttactgaatttctcatgctcgatgttgccttgttcgtaagagtagcccactcccaggtagaaactatgtttgggcgaagcccctgtaatactgatgttattgtttgtaatgaaagcagtctggaaaatttcgtcttgccagtcggtattggcatcccagccggtataatcgaaagggtcatctttctgattggcgagctgttcgttatatagttccttgaattgtgaaccattcaccaatttcactttatctaccactttcttgaaaccgaaagaagtattgatattgaccagtgtctgtccctctttggctttttttgtggtaatgatgataacaccattcgcaccgcgaacaccgaagatagccagagatgacgggtctttcaggatttccatggattcgatgtcctccggattcaggaaattgatgttgtcattgaataatccgtcgacaatgtacagcggtttatatccgttgatggagtttgttccgcgaatacggatttccgggtccgatccggctcgtccggagtttacaatctgcacacctgccactttcccctgaagggaagatagcggattcattgccggtttgttggctaactcttctcctttgatattggtgatagaacctgtcaagtctcttttctttgcactaccgtatccgataacgactgtttcggctagtacttgtgaatcttcttttaaagtgacattgatgacgttctgtgtccccactttaatggtttgcgaagtcatccccacgtatgaaaatgccagtacgtcctccggagtgacagagattgaatatttaccgtccatgtccgtgatggttccggtggaagttccttgtacgagtaccgatgcgccgatcaatggttcattggcagcgtccgtcactgttcctgtcaccgtctttgtctgtgcaaaggctgatgcagaggccagtagcaggcaaacaagcgtcatgatgctctttgacctgatggcttttttctgaagatgttgtaaaagtctagtcctcattgcattaaatttttccatttgttattatttaggttgaagtcttttttctgccgtcttttggcaagagtaacaaaggaaacaaacgaaattcaaaaaagattttggaaaaaagagggaatggttgattttaacactaaaagagaggtgactgttgaaaaaagtcaggcacgaaccggtgttgttcgtgcctgaataatgggatgaggattacccgtcgggggaggtatatcctatatatacgctgttcgttttatgatttcctgttttaaaacatctgttccgcagtggtcatacattgaatgacatcttctttgctgccattgaaaggacctgatttctctatttttaaagttgacatggctgctgcaaaacgtcctgcttcttcgatgccggcacccgatacccgttggtatagatacccgatggtgtaagtgtctccacaccctgttgcatctaccacttctttgggtttatatgccggaatacgatagaagtcttttccgtcgaaaataagtgatcccatgcttcccaaggtgacaagcacttctttcacgccccattcatataattgacgggcagcttcatgcggatcggaaagacttgtcagcacttccatctcgtgctcgttgactttcagaaaatggatatattgcagagcctcccgcttatctatccaatccaccggatagacgtgggtgtcacgtacttcacgtaaatagccttgtgagtctactgcaatcaaccctttttgagatagttctttgattacttccaacgagaagtcgtctgccagcagagagccgagatggtagatttgcgcatctatatctttcagctgaccggcagtgaacggatcggctttcgctaatacacgttgagtacggtcgtccggattggcgccatagatattctcgaagtatacggaatatttgcttggcagggcggttacatgaatacccatttcacgtagttgctccacgacgttcatttcagtgacaccaactgctgttactaaagcgtaatcgatgtcgttaaaatggcggatggcatgtgaacaataaaaagccgttcctcccggcatatagacagtgttttggggagtgactactttgtctaatgtgatgtgaccgatgcagcaaagttgatgtttattcatgtctaaccaattaaaaagcctccaagatagtatcttgaaggcttctagtttatttttagtgcggctgataggactcgaacctacacgtctcacgacaccagatcctaagtctggcgcggctaccaattacgccacagccgcatgtgtagcttttttgtttagcggtgcaaagataggaagattttctgatttggcaaataatttggcaataaagttattcacttaagatttcgaatgccttttcaatcagtggatctttcttttgtgattctatgtcaccctgctctatcccttcttccagaatcttatccatgtttacgtatacatcaggttttattccatcttccaatgactttccatacttatcaaaatgggggctggcagagaagcggacgctccagccattgggtaattctgatgaaaatggcagccctgatcctccaccagtctggtcgcccagctggatgattcttttatcttcgttatcattgtttaagctgcgcattatgttaacaaaatcatttgtggcactataacatcgacgattggttagtatcacgacctttttttgccaacgaatactgttggagggttctaaataaatgggttccatctctgagaaatcattgtgtcccggacctgtcttatgttggatatatcctgttaatgccagtttatcagtgaaccgggcagctatgcgtgaagaattggttagattacctcctccgttatcacggacatcgataattagtccattgcagatttgtaaatagtaaaggacctcatccaaattgccatctccaactccggcactgaaactttcataacgtatgtatcctatgttattgtcgaatattttatatttaagaccagcggatgtgcgataacctgaattggcactacccagataatagttataaagaatatcttctctataattccaagggtagccctgataccatgcatcgtaataagaaatacgactggcagaagatagattgacatgcccgtctttcaagatataaagcatttggcttaggatgtcgaacaggtcatcattagacattgacggaataatcagtttgctgtattcgtcatgaacagcatcccagtcaatacctttcgtatccaggaaacaatactgttcgtcaatgatcttccatagttgttcgaaattacctttgggatcattggcgtagtcatcttccccaatgcaaccagtcagcaccggaaggcagcagagcagccaaagtatttgtctaatcttatttctcatcattaattgatctctcacttgaagtttcaacattaaattttgttctcttagtaagctctaaccgatgaaggaagagcggttgctttcttatttcggatacggtataggtctttcacaaatcctaccatgaatacgtgtgagtaggtatgtgtcttgatattgttaacgttggattgctgcaagtcagccaggtagctgaagcgcattttggtatatcctatcggcaggtcgacggagagcatctgtcgcaacgaaggttgattgtgcagggaggtaaattttattactccactcgaatttcccaaagagaatatctcgtaataagattgtccgtagtggggagagaacatcactcccataaccggcagattgacctgataacgaagcaccattggataccgtttgattttcaggtgccaaatagccattccggaggcatccagattgacgtatgcccgtgcggatgccggattgttggtgttccggagattatagacaaagcctccgttgacatctatcaatcctccggctaataatttgaaattatctgtcaggcggaactggtaatgtaatccatagttccagttgactaatccggagaaagtgttattgttatcggcccggttgtgcgtatagctgatgtttgcctgaaagaagttctgcacagatacatttccatcaaacaacttggtcatccgaatcaattcacgggaaacacggaagtcgattcctttgtattcctgcggtgaaagataggtgtcgaaaacgttagtaaatccgacaccatacatggtggcacgtgttacataccgatgggcttgcagactgtcgatctgcgcttgtaatcttgtgcaaagggcgaacaggatgcaacctgtcagccccaagtatattagttttttcttcatcagaataatttcatctgcccggtgatttcatcaataatatcgccttcgctcttgccgctgtccggatccagattttccggctcctcttcaggaacttcctgttgttcttgtgagggttcggggaagcgagttggttcaagctcattgatcgtctccactgcataggtagtgatacgttttcccttggctttgaaacctttgacagcaatgaattcatccgcatcgatattcaacggatcacggaaattgtcgtgtccgccaaatatgacttccagacgaggatagtactcgtcggtcagcaggatcagacggttgttcttattttctcccaagtagttctgtttacggttggaggcctcaagacagaaacgtttcagatacggataattctgttggtcggcatcgtaaagcgcggcagtccatatcttgttaggatcaaacttctccacgatgcttacattatcttcatagtggttgctcaagtcgaagttggtagtatagaaatcaccgttgttcagaacaatcaatatgctgtcgtcgctttggaattcacccagatattcacctcgtccgtcatagttgaggcggagtatgtcacggtcaaaccatactttacgtccaccgagcgtggaacctcctttttgtttcagggatatcttatgtaccggcaagcgggtaagaatcacgcctcgtgcctgacgtcccttgatgctgacctcactgaagtcatgctcgaaaatgatacggcgtacacgcggattcggtttcagtgtcaccttgatgatttcggcttctccattcgggttggcgctgaaataggtaatccgtgattcgggagttccctgtgtgacatcatattcgcggtcgcgaactacagaggtcacggcgaaacgttttacgtatgtcgttccttcttttccgtcgcggtaggctacattgtagatcgtacgtttatcgttcttcttgaatacattgacatagagaacgtttttgccgacgaacttcttgtcggcaacaggagttacgatatacttaccgtcgcggaagaagataatgacatcatcgatatccgaacaacatgctacgaactcgtcttttttcaaggctgttccgataaatccttcttcgcggttgatataaagtttttcgtttgcttctactactttggcagcttcgatggtgtcgaagttacgcagttccgtacggcgcgggaagttcttgccgtatttgtttttcaacatctgataccagttgacggtataatctacgatgtgagccagatgattatcaatctcggccacttcttctttcatcttggcaatcagttcatccgctttgtccgagttgaatttcagaatacgccccattttgatttccatcagtttgagaatatcctctttggttacttcgcggataaatttcggataataaggcgtcaggcgttcgtcaatatgagcacaagctgcgtccatatctttggattgttcgaactctttgtccttatagatgcgttcttcgataaatatcttttcgagcgaagcaaagtgcaacgcttccagtatttcgtttttcttgatttccagctcctgctttagcaaatccagcgtgttgtctgccgactttctcaagactttgctgacagtgaggaaatgaggtttgctgtcatcaatcacgcagcagttgggtgagatacttacttcgcaatcggtgaatgcgtacaatgcatcgattgttttgtccgatgatgtacctggtgccagatgcactaatatttctacgttggcagctgtgttgtcatctaccttgcgaattttgatttttcctttatcaacagcttttaggatagagtcgatcactgttgaagtggttttcccataagggatctctgtgattgcaagtgttttgttatcaatcttgttgatcttggcacgtactttcactgctccgccacgttctccgtcgttgtatttggctacatcaatcgagccgcctgtctggaaatcgggatacagttggaattcttccccacgcagatagctgatggaagcatcacaaagttcgttgaagttatgcggcaatatcttggaagaaagtccaacggcgataccttccactccctgcgccagtaataacgggaatttcacaggaagagtgactggttccttatttcgtccgtcgtatgacaatttccattcagtagttttgggattgaagacaacatccagcgcaaacttggataaacgtgcctcgatataacggggagcagccgcaccgtctccggtgaggatattaccccagttaccctgacagtcaatcaacaggtctttctgtcccaactgtaccaaggcatccccgatagaagcatccccatgcgggtggaactgcatggtgtgtcccacaatatttgccactttgttataccgcccgtcatccagacgtttcatagaatgcaggatacgacgttgcacaggctttaaaccgtcattgatgtgaggtacggcacgttccagaataacatatgaagcatagtccagaaaccaattctggtacatgcctgttaactgatgttttacgctttcgtcccgcgcgtccgccggtttgtagtctgaatgttcttccgttatctcgttgatttcgtcactcataaaattcgtatatactataattttaacgcatacgcacgcaaaaatacaaaaataaaagagatttcgatgaaaaacggtgaatattccgtgtgttaaaagggtataaatcagctttacggaaggaaaacagaaaggcatatcctatcaaagacatgcctttctgtaaaattataacctgatgaaaaaacgagaaatgggtacatgatttaaacccgtatttcccaacctttttcgtactctcttccccaaagtttattagcttccaaatcgttaagaattcgtccgcttcccggatcaatctgtaatgaatgtccgacacgttgggcaatattacctaattgtaccaactgggtactgatacaggcatctacaattccggaatttaactttgttcctttgcgaatggcatcaaaccagtttcggaagtgaaaggcatccagcttttcggatggattcaacagattgccagtctcaaattttaaatcactttttacctctttaatcgttttaccttttaaatctgcaattttatattcattgccaccgccaatgaagagagttccggtttctccataaaatgcagttcctactccatatccgtctaccggcatcgtattacaactacgtccttcccatgaaaaagatgcttcgtcaccaaattggaaggtgataagttgtgtgtcaggagtttgccagtcgtcctgaaaacgataccgacctccgatagaatcaacctttgtaggataatctacacccaatccccagcggagtatatcaacaaagtgagttccattgttgagcgcttcacctgttccccaattccagaaccaatgccagttataatggatgaaattatctttgaaatcagcaacacgtggggcaggaccttgccataaatcccaatccagataatcaggtacaggaacaactttccctgttccaatggaagggcgattattgacataccaagatttggcatatctcacttttccgatagaaccggattttatttcttccatagctttaattacattgggaaaggaacggcgttggttacccacttgaacaatccggttatatttcaaagcggctcgaaccaacatttcattttctgccggattatgactggtcggtttttccagataaacatgctttccggcctgcatagccataatggctgctttggcatgccaatggtcaggggtagcaatcaccactgcttcaaaatcgttcgactctaacatcttacgaatgtctttttctcctttgggagtacgtccggtaattttgtggatagcagcctgacatttttctaatgctcttgagtctacatcacaaatgtaagtaacttcacaatctggaagtttggcaaatccttgcgccagggccttacctctcgaattcactccaatgactccgatacgtattttttcgttagctcccagaatatcttgataacggcttgaaccgaatcctggaagtatgcttcctaatgagagtgcagctgtacctgctactgtttttttgataaaatctcttcttgttgtcatagtatctatttttctccaaaattaggttgttattagaatatgtgaatgagcttttccgtcaattctccttcaaaaaacgtaaatctcttatttttttcttcggaaaaggtgactcaagaatatcaggattcctcggggaatccataatataagatagatgaaaaaactaatcacgatgacatacccgatttgggatattatttcaatccatgggcgggaatagataatgattgcaattacattgatgataaatgcaagcaggaaacttagaagatagatattcctttcttgtttcagcttttttgatgtgataataatatctttcatggcttagaatttcatatagggtattttatattcgttggggaagaggatatggcgttgttcatccattgcttgattcccaagtaagcaaaggaccgtagaacaataagcctcttctactacattctgtgctttctctccagtgatacaagattggcagaaagaggatagaatgatatccgatccgtctttatctgctccgatcatacttaaaccactgttaacgtgaatatctccgtcaatgataaaatgtggagtgtattccatttttgtttccggtcgccaactaggtcccgctgttggtatagcggcaaaagctttgtcttttacctggtcaatcagttggcggatgcccgaagtagaatggtcttcttccaggtaataaatacctttagccatatccatcgtacctttacttcccagaatttggtcttccattccgttgaacttgttggcgattaatgattcatatgcaatcttggttccgtcggaatatcgataagtcacatttacactatcgtatacttcacgaccgtctttccagtaaacaatatcacccattcccatgatacttaccggcattctttttgcggcccagttacatacttccaattgatggcaagctagttcagtcattagtccgcccgaactgtctttatataatctccaattgattttgcgctccaattccggtgaaggagcaggacgacgccagtctgcatttctgaaccaatgacagcgcattcctaccacatctccgatcaatccggaatgaatcatttgcatccctttgatatacttctcgtcgtacattcgttgcatacaaaagtagagtactttttcagactggttgtaagtgtcatagatagccttgcactcgtcaagggtgcgtgccattgctttttcacagaagacatgtttgccggcagctaatgcgtccaacacaataggtgcgtgccagtttagtggtgtggatatgatgactccatcgatgtctttcgattccagcaacttacggtaatctgtataggatttggcatccgggcaaagctccaatgcttgctgaagattgggagcataattgtcacacacggctacaatttgtgcatgaggtatttccttgaggttatggatgtggtattgccctctggaacctgtgccaattaaagcgattcgtgctttttcatgcttgatctcttttagcttttcaggggtacaggaagtaagccagggagtggtcgctaataaagcggttcctccggcaacatatcccagactttttataaattgtctgagtcctaagtcaactcctttttctttatgttctttcatattataagtcatatatggttgcttgtatatttttaaaattctctgtgagtaatagttgctcttctttattcgcaatcatccatacggtacttagaatttcagcttctaacggatctgctgatatgatagagcttgcttttcgttgttcattaaatagacccgtaagcggattcataatgtgtccggtataatgtatcgtattaccggaggtggataatgttgtattttcaagatcgaattcatttaaaagagactgattataaggattcagaaaactcactttccaactgtctccatacgggtggtgtcccatgcccagaattgagctattgccgaaattgacaaacgcatgattgacatccttttgctctatgagtcttttgattttcttcaaagcataccctttggcaaagcctccgaaatcgagtgaaatatcaggagacataaaggaaatgcgttgatggtcgtgaatttgtattttggagaaatcttttaatgtaatgtcaaatagatgaaaggtgttttcataataatattggcaaagttgcaatatttcctccagttctttgctaatttgaatataacttagcaaagcatgtttattaattccggagacctcactgtggggatcaaaacggttcaagatcttatccaaacgttccagctcgttgatgatatggcaccaaagtccgtttaaacgttctgcatcagaatgaataagcaagatatcgaatcgtgtccccatgatatgaggaatgaagccatgaaacatggcttcatctttataatatttacatcctgtctctaacacctattgtcttatttattttctttctttgccatttctacagcagttgtagtaatgtaatatttggttaatgtatttgcgttttcccattccgggatgtttttgttacgtatataatgcaggaaagcttttgctactttactgaagtgctcttcatgtcctagtctgtattcctgtggtatatcaataagataaatcccgttacttttatttttgacggataagaacggatagctttcttgaagttgttctatcgtcttttgcaattgagtctcaaaagtatggctgtcaatgtttggctttttctgaatatacaattctttcacaaaaccgttcttctcattttgaacgatttttaaagttgctttgctaccttttttgatagaagtaaacgtatctcctccatgaactggtggcatataattccatgtgactttcattcccatacaaattcctttgacggtgtagttgagacttccgtttgccataactttcaatacatcattttttatgtattgtttcagataaatagggaaagagtctgtttgcgttgattggctgaactctgccaatgtgatcggggttggccagtgtttggccgaaagtactttgacatccgattgataatgaattgcttcatctggaaaacattgccagttgataagatctatcaaatgtgttgttacatctgcaattccttctccttgttgtgctatatcatagtaccatgcaggacggaccagcggttttccggaaacctttttaaagaaatgatgtacgctttccattattacagaagggttgtccggtgagcctttttgtaattctccaaataattctgtttgatgtaagagctctttttctatgatgttgagaatatcatatcgctccgtcatcaaatcatataaaaggagccccttttgttgtgctagctgataagcctctgtcaataattggaagtcctgtgagttaatagccagtggcttatctgcaagaacattatatccggctttgatagattctataatatatcgtgtcttcttctgattatttccagccagaattacgacatcacctttatgatctgaaagcattttctggagataatcttcgcctgtatatacctgtttcttccacgtggtgggagactctgttcgatggttgtaagagtcaatactttccagatattgattgacgcctattccttcgggagcgtatatccggatggtatcattaataacagctaatgcatctttctgaagcagactggcatggaaatgtcctggatcaagaacgactacttctattttacatgaatcattggcttccgccttattcatagtctgtttcttggagaaagaacatgaagcaactataaataagattgatataagcccgattcctttatatataaatttcattttcttatttattatagattttgattaatttccgggcgtctttccatcctttttggtaagcttcttccaatgtgacaattcttccattctcttctttactcatattggatgctttcatgaaagtgaatatttcaattgtttcttctctggagataggagagattcctgtttggaaaaaaatcaaaatttgttcaagaagtactttatatccttgataacctcctacttcaatagcctttttggtgccgaacgctgttcctccataaatggcaggtcctttttttattcctctgaaagttccgatccgtccatctttccaacgtccgaccacaatatctgcattttctgaagacattcggttaactgattcacagccggttcccataatcgtatatagagtctctattccatgtattccgtaaaaaccgaaatccggatgtgtaggttccactttatgcggagagtagcagtcggctcctataatatctccaaattctccgtttcttaatttttgattttgtggagaatatcttaatgctgaagaagaaaaaatagggaccttatatttttctgccatctcgaagatagcaatggcttcgcctaatgttgaaccgatcggtttatcaatatagcagatttttcctgatttgaagacttcgatagcttgttcgagatgaagcctgccatcatttgtttctaaaagtacacaatctactttatccaataactcgctgattgaagacacaatctctactccttgttgttctactttcttaatataacccggaatacgcttagcactggattcaatagtttttgaaccatacggataggccgcaacgattctaaagcctttggcaaaagcattgtctttatctccattaattaaatctgtaaaggctacagaatgggaagtatctagaccgataattcctattcgtatagatttttgtgcatgaatattcaaaacgaaacttgataaaataagaagtagacatagtttgtttttcataattcttttcaattaaaatattagaagttataaattgagtaactgtgcactttctgtgtccaaatataacgaagatttttcttttctccgcaatatactggccggacatttttcagaaatatctccatggattgtgcgatagacagcttgagacttattcttgaaaggcacgatgcaaaacatccatttggcttttaataatgccggtatagtaagagttaaagcttccgtaggcacctgttcaagtgtctcaaaacatttttcattgacttgttgctggcggcacacatgatcaagttttactatctttactagtttgtgatcgttgaaattggcaacatcagggtcgttgaaagcaatgtgtccgttttcaccgattcctaagcagacaatatcagtggggaattgtgacaataaacttgtgtatcgtgtacattcctcttccagatcagtagcatgcccgtttaaataatagacattcttgaaaggtaccttatcaaaaatacgtattcggaggaagtttccgaaactttgcggcgcatcaggcagcactccaatatattcgtccatgtgaaaagcattgattctgttccagctaattcgctgatcgctgatcaagtgatgtagaaattcttcttgtgaaggagctgcggcaaatatcatattgatttcagcttttccttccaataaattgcatattctgtcagctacttcttgagcggcggcttttcccatttgctggacggttgggtagattttgacagttaattgattttgttgaaatactttagtttcagtttcatttactatagataacatggccttctgatattgtgtgaatgatattaatttgattgtcgaaaataacgatgtccgcatctttcccggcctccagtgaaccttttgacttgtcgatatggaggatacgggcaggagtaagtgtcatcatacgaatggcattgatgagactgacgtcggccagttgtaccattgttctgaccagacggttagtggtggctacacttcctgcaaatgcggaacggtcaggcattttggctactccgtcttcgatgattactttttgtccgttagccagacttcctaatatggattctccgtcaggcatacctgctccccgcatggcgtcagtacagagagctatcttgtcagctcctttaaatttgtaaacaaattgcagtaatggtttagggagatggataccgtcggctatgatttccactgtcatatcatcaattaggtatgcagcttctactactcctgcatagcgaaaggcatttctgcgtgtgacagatgacatcgctgaatataaatgggttatatgcgtataaccggctttatatgcttgtgttacttcttcatagatcgcatcggtatgggcaatagaaggaagtatgtggtgctcttgtaaaacatgtcccattttaatagctccctccaattcaggagcgacactccagcgtataatatcttccgaagattctagaatagcgttatattcttccggttgtggcttcttcaagtatataggatcttgtgctccgctttgtttgggggagaagtaaggtccttctaaatgtaaaccgatgaactttgctccttttgtgttgaggactttagctttccgataggtagcaaacatattcattaattctgtgtcagagcatgtcagtgtagtgggaaccatggaagtggttccatatttcgcatgagtttctgctatgcctagaaatgcctctacggtgccatccatgaagtcgtggccgccaccgccatgaatgtgcatatcgatgaatcctggtgctacgtaattaccggcagcatctattatttggtcatcgggttgaggcgtgaattcattactcgctacaatttgcctgattttctgatttatacatatcagtatcttatcagtttctatgcttgtaggtaaaatgatttttccgttggtaataataagtcttttcattgtatgaagtatgtctttttatcaatagtttcgtttccaggaattgattttatggcctttggttgcaaagaatatcagataaaggaaacacggaattaatatccagtagccaatgcgcagatcatatacttcagcaaaataaccgtatatcaatggtaaaatggcatttccgcaaagtcccataattagtagtgaagaacctgttttggtgaacttgcccagtccgtggatggataaaggccatatcccggcataaattaaagcattcgggaagccgagtgcacaaagcaggaagatggagatatttgcttgatgtccgaatagagtgacgttaaaatcagcgaatacaactccgaatgaaagtaacagtcctaatatggtacatataatcaacgcctttgtctgtgagacatatttaggaattataaggatgcctaatacataaccaatcatagtacaagctagtgtatatgaggggaatacttttgcttcaagcaagtctattcccattgaattggcgtaattgatgatggtatctatagcaattacctgtgtccctacatggaagaaaatagctaaagctcctaatataagataaggaaaatcgaaaatactttttttagagttatgcccgttctctttctcgtcggttgcattttgttcatctgtattaatctccggcaatatggaatagcggattccgattccagctaatactaatagtccccctagtatggcataaggtacaatgacacgttgtatcaactcgtcaagcatggcacttttagttattgcatccaatgtaccagattctatgaggctgaaaagttcactgtcgtctgcttttaaaattaaagctgcgaaaatgagtggagaaataatcccggcgaacttgttgcatattcccatgatgctgattcgtcgggcggcgctctcaataggaccgatgatcgttacataggggttggcagcagtttgtaaaatagccaagcctgttccaatagaaaataggccgatcaggaatatttcaaattgtcgaactaaagcagccggaacaaaaagaaaagctcctaatgccgtcaacataaaaccatacatgattcctcgtttgaaacctactttcttcaggaggattcctgaaggaatagccatgacaaaataggctatataaaaagcaaaagccacgaagtaggattcgaaatgggttagttcgcaagcgatacggaaataaggaatcaggatggagttcacccatgatacaaatccgaatataaaaaacattccggctaggatcgtcagcgatatgaaatattgcttttgtttacaagagtttggcattccttttctattttataagtatgacagttttgtttctattattgaagactgatttgcatggatagtcgtgatgcatatactcctccagtgtaatcttgtactttgagcgtaaaggtatctgttgtaccttgaccgttgtggatgtacttcactataccggctgctatttcggcctgtgtgaattgtgccgatttgcctattggaagcccgttgtgtacaagtgtgccattgattggcaattgctctatgataaaaataatattgttgtcatcgtatgtatattgtgcactggggccggcagacatctgcaagtgctgtttggtcaatgtgatgatgccgccgatactcccttttattatttgattatgatctagttgaagctcactgtcggtggcaccttgtaatttgatataggcagcattaggactattatttaagtttgtagaagatgtttcacgcggatgtatttctacttgagaattactgatggcctgaccgttcagtagttttaaaccgaaagagacttctgcttctgaattattataagcatttttgatatattgtgtgatattgatttcattccagtcagctgacaggtcagcgatagaaacttccgctccgaattccggacgattactataagtcaatgttttttccgtccattcgtttgacgttgcgtaaacaccgcacgaaggaacgaatgagcctactattcttttgatattaaaacataatttggccgaaaaaagattgtcgataaggtctacttgagataaggcgaatttgaagaaagaatatctgtaacgcccggaacggctacatagatagtttaatttgttatacccattgtagttgccattggaagcgccgctatatacattggcgtcttcagtcacaggcagattataggtgggagcttgtgagtggtcgacaccttccggaacaggatctgtttctttcacctttttgatatataaaggtaattggtctacgacatgtgctgcaccatccttgaaaaggtagtcttgccggatgacaacaatagattgattgttgatttcttcgctatcatttacatagagaagaaacttgttacttgtactttctttacgagttaagaaaataggttctccggagtcactgataccttttatactttggttggtttccatttcaatggaacggtaggaaccgtcaaaagtcagataggaaaataggtagcggatgacccctttggacagttggttgatttgttctactccgacactggataatacactctttatggcatcgttggtcggaataatgcgtgttcggtttccggtagagatttgttcttccaaaccggcatatttaattgcttccaaatacattgtaagcgaactttctttcccttcttcaaggtactctatcaaggacatctctttcagataattcggatcggtgtctaacttataatcggttatcaaattacaaccggaaaaaagtagagctgcaattaacagcatatattgagtcagtttcatattttcagcttttaataagtaaaattatttataatattcgttctgctcgatcaatttgcttcggcgtaattcattgaggtgaatcggccataccaacgcttttggatgtagttcgatagcgggagactcatcttctccgatatcattacctctatttttgacagcttcgaaaactttacctgtacggataaggtcaaaccaccgatgtccctcataggctaattcatacctgcgttcattgagaacgatttctctgattccttcctgatcatattcttcacggttgagaaactgttcttcaggaatttcataaccgcttccggcagctcttctccttatttggttcactaacttcattatcgccttccggttttcgtcggtgtcttcttggttggcgattgcttcggcctttaataaaattatatctgcgaggcgaagcattacaatgttacgactgtcggcagtataatcgaatccaatagtgaatttggtaactttgtattttccgctaactgcctcatgtattgcggctgatctccaagaacttccttctgtgtcgatagcttctccgaatcttgtgcgcgggcgtaggatagggtatgtgccggataaataagatgtcaggttcttttggtcatctccatcggcaacactgcttgccaattcgaaaattgactctttactgcgtccggcattaaatatttgtgcgtattcactggcctgcacgaatgctttgaagtttttgtctttgggattatctgttacaccggtatatttttcatcgtataagtttgccaaagtataaccggtattagccagtactttatctgccatactgattgttttctcatatttgtgttcccaagcatatacatgagcatcaatggcataagcagccgtctgggtgaaagtagtccgtgaggccgaattcttatcaatcatttttgcggcattttccagatcagagtgtatctgcttgataatttcggctacactagttctagggcggtcaaaattatcgttggaatccatataaggctccgttaccaaaggggcatctccccaaatacgaataatccaaaagtaagcgaaagcacgcaggcaataagcttgccccattacgtcgtttgctttttctgtgcttatgccgcctgcttcgagcacttgcggggtgaatttaataacaacatttgcttgtttgatagcgcggtaataattataccatgaagcttgagatatattattgtcaagtgaattattaaccactttatcagtatttacgttaaatgcattattatagaaagcatcacctctcatttcaccatagatcaggaagttaatactcaaatcagattgaagagtattgtatcctccatacaggatgccatatagatgtgattcctctttgggggtgttttctgttgaccatgatgttgtcggttccagttcaagaagagaacaggcagaaaaaccggcgcttataaaacatattagatatatatatagcgttttcatatttgataatatttacaggtgattagaatgtgaggttgactcctagattgtaagaacggcttttgggaaacgcaccgttgtctactcctcggataaatgccgatgtagcagtatttacttccgggtcgtatccgctatatttgctccaagtaaggagattcgttccggatatgtatacattggcagatttcaagaatgcttttttgcaccatttgcgagggatattatagcttaaagtcacctccttgatacgtaggaaagaaccatcttccatgttgaaagaagaaggacggaagttctccattttgtcctggtaacgaatcatggggaaattggtaatgtctccttgtgctttccagcgtgctaatgcatcctgtcccaaattaccggtggttctcatggcattgcgcgtacgtctgaactcattcataactttattcccataagaccattgcatcatgatattgagagaaatccccttgtatgagaatgtgttggacataccgccgataaatttaggattggggtcgccaatgatgacacggtcattgtcatcaatgactccgtttccgtcaatatcctcccagatcatgtctccacctttaaatgggtcaccggtggaggctcctttgcgtatttgatctttttggccgttaggcagtatatacacgttatcctcatctttggaatagacacccagtgctctgtgggcatagaatacccccattggttcgccaacccttcccagcgaaaagtttcctatgatgatatcctcattgttgggcagttcggtgattttattccggttcatggaaatattgaaagacgttttccatttgaacctaccggtcaggttgactgtttcgagtagaaactccaaccctttattttctacactgccatagtttctggggacagcggagaagccggtatagtaggaaacggggaagtcgaacaacaaatccttcgttttctttacatatgcatcggcgttgaataccacacgacctttgaaaaaagaaagatctaaaccgatattatattgagtcgttttttcccatccgatgatgtcgttgggcattgcgttgtagagaatttccacatttccgtcgtatttgttggatgaggctgtataagatcccaatgccgcataattagaaatagtctgattacctgttacgccaatactaccacggattttagcgtcacgtaagaaacctttggcaaaattcataaatttctcatcggaaaagcgccatcccatagagactgacgggaatgtaccaaaacgtttattcttaccaaaacgagaggagccgtcgttacggatagtggctgatgcaaggtaacgtcctttccaatcatagctgacacgcccgaaaaaggaaagtagtgctctttccgattcgcttctggatatattggtataagtggatgcattttgaatggtgatcacagatttgtcaatgtatccgtttccgtttaatgtgatggtttccgttttgtcttgctgtaatgattgcccgagtaccacattcaaacgatgtgatttgaattttccgttataagataaagtgttttcatttaaaaaagtttgtccctcactctgccggaacttgccattgtcgcgggctggcgtattggagtcgaattctttaggcatgaagctgtcttgattggttctgctgatgtcaccagacacgctcactctcaaatcgagccctttcatcagatttatttgtatatattggttcatcgtgaaccaacggcgtttaaagtgaatgggcactttcgtcgctacggccaacgggttgcgttgttctctcactcctagccagtctaccaattcaccactaagaggatcatagggagagaaacaaggattggtgaatagggcggctcttaatgcactgtaattattgctacccgaagaaaggatacgggtataattcatattactgaatgagactttggttcctcctgtgatgcgttttcctaccttatataagaagtttgttcttagattgagctgattgtatttcgtgttgactactactggtttaagatcgcgatatccggctgatacaccgtaagagaaactattgtttccaccacgtacacttatgtcattgcgggtttgatatgctgttctgaatatgacgtcctgccagtccgtcgtgcggttatagtaagggtgaaatgggtttacaatccagttttgttcggcagtctgattattattttcacgagcttctttatatgcagcacgaaattgttcagcattcatcgcatccagtttgcgtgaaatggaaacgatacttgacgtatggctaagtgtaacaaccggtgccattttttcaaacttattaccgcctttggttgtaataatgacgataccgttggcagcacgtgaaccgtaaatagcggcagaagctgcatcttttagtacctcgatagattcgatgtcattgggattaatacctgcaatggggctgaaggtagcatcaccgtcaatagaggatatatttccgctttcaatcggtgtaccgtctataatatagagaggttcgctactcccgtttatcgaagaagcaccacggatttgaatcaatgatccggctcctggttcaccggacgttgatatgatttgcatacccggaatttttccctgcaaagcagtattgatatttcctccggaattagaatccaggtctttggatgaaatagtcgtaatggaaccgataacatcacgtttggcctgagtcccataacctataactatgacgtcttccaatgaattgtattcttcttccagttcaatcacgtaactggatttgttggcttccagtttgattgttttcttttgcattccgacataacttatttcaagttctttgtcagattgtccgacggagatagtaaacttaccatgggtgttagttactgttccccgtctcgtccctttaatgatgacatttgctccaatgattagttcttggtcgttttctccttttacaatgccggatattttccgttcttgtgcaaaaaggtccatagagcagaggatgaccccgataaaaaatagaaggactttgtttttcatactataaatttgaattaaacgatttaagtgctttatgtatctagcataagtttacaacaaaaatagaggatttgccatttcttcatcagtggaaatacgcaaattagtcctcatttcgcgttaataacatcttacggtttcctcatttctggcaaaagggtggaacctggtactaataattccatagcccatagggcgcttaaagctgcatattttgataccgttaatgattctccgtgtacagctttaggataattttcagataaacgtttcattgacccgaatgaactttcagaaccgaatgcccagatatattttagtaaaatggctctgacctccggtgaatcttgaatgttgcgcttgtaatatagtagtggtaaggcatttaatgtacaacgccctcctcggagatacatctcattctcacatccttttaatagaggaggaatgaaagtccgctttagattgctatctattatttcattcaggttgtgatcgtttaatacagaccggacccagaataaggcttcagcttgatagtagcctgaagcgggatacactgcttttacataatagttggcatttcttttggcaattgcttggtattgtattcgggtcgcatctttttgtagtgctcccatacaaagttggactgccaggatatctgctccgacccaggaagggcctgtcagtactttttttcttccatattctcccaaaccatacattccttcgtaagcattccctttttcaaactcttgaggatcacttatttttaattgggcggagcgtatgctgtctatataaaacgtttctgcccagttgaggaatcgtgaacagagtttctgatatttttcttttcgggcataatcagttatataaggtaaagattgtgcgatagccagggttatttgtccgccgtctgcaacattgtatccgtctgaatgttccaaatatcccatagggagtttgccatcttcagtttgcctgtcagctagcatatcgtaaaaacgaaatgcgcaatcttctatttctttcggagttatgagctggaagtcatcattactttttaaacagctcattccattttgtaagaaatgtagataagcgaacatagctcttactccgtaggcatctccaaaataatggtggctgatacgtccgtccgggtagaattgctggttacgtactagatgcctgaaggcatagagcatcgctttctttacatctaccgaatcacagaacacatctgtctcatttccattgttttttagtgttatttgccaggtaaaatgttggaaaggaaagtcttccggtatttcggggagaggtatgtaacattctttgacttccaggggagcaatggtaagatcagctttttgtgatagttttccggcaatttcgatattcagtttgcccctcacagtttgcgataaagggtttttgacagtaatatgtaattgtggtcgtattttctcattgattacgcaggtattgatcttggtcgcaattattttaggtttctccaagaggtaatgtatgatgttggaaagtgcttgctgactttccggcttcttgagagttactgttggcggaagatcgaatgttgcaactgccgaacctttatattctcctccggcatataactctaaattaccgataggttgctctgcttttttggaagaaagttctgacaggattggaatgatacgactttcgcgtttctgtttcgtatcatatttggcgttgtggtcacttcccattttgctaccaggataagtggagtagttgttccgttccccccggaacgggtcaaatagccatgcagggaaacatatattattttctttaaaaggaagttccattggcttcaaggcagaggttggagcataaatatcttttttatttttcgctaaagataaacaactgattccccagtacatttctttttcacgccatacagttagcaggttaactccgatagatatggtcctgatattttcagggcgtagcaatggataagcttcattcggattattataatcttcgggtataaaatcagcaaatgaaagggtgtatttttcccatgtatcagttagttttgtaaagttgtaccatttcttgcctgtatgatctactatctccaacgctaataaatccatatagggagaaccttttgcgttgaatgtcagcagtgaaagttccggttttactttatcttgagcggatatttctaccatcatactgtgcatggccttcttagtcgtaaaaagttccagagcttctttgttatcaggtgatgttgtgactttgattgtagccttttcccgatagccgggcagttctttctctttgcgatttatttggtaagaagaccgatcggaaaacttaaccaatggaacttcatccgtagcttgtggagcgtagtcaaaccctttatcgccgacaacgattacatttcctccggctgataaataacggttaatcgcaattcggctttcgggcggcagcggtgtgctaccggacaataagagtaattgtccgtcggctgtggatattgcatttaatcctgctcgggttaaatgtatagtttcgaagccattaacaccccgtttgatcttttttgccagacccttgagctcgtcaccatatattgcaatttttttcttatcatgttggtgtgagtttgtcgaccggtcagtgggatacatacgtatcgtctttagagctgatgattgtccggatataaagaataataagctgatgataaaaagtattcgtttcataatattaggacatttgatgttcgttagacaaaagtgcgtaattatcaggatattactcattgtaaaaccgaaaaacaatattcaaaaaacgcattatttcagttccttgatcttcacgtttttgaaccaaacttcatcgccgtgatcctgaagaagtatatttccttctttggcatttccgaaattaggccagtctctatatttgctatatgctactaatgcattccacatatcgctgttacgagtatattctatcaatttaactccattcagccaatgttccacatggttgccttttacaataatggtagctgtattgaatgtttttttattgaaaggtttattttctggggccggaatcaaatcatataccgatcctaatttcctgtttcctttcacacccaattttgcgtccggatgtttagcgtcatcaagtatctggaattcacagccgatagcagaaccttcgcctttattcaagtccggattaacgaaatacttaattccgctattcgctccttcggtaattttgaagtctactttcagaataaagttcttatatttacgagtagtcacaatatcaccaccgttggccgattcggcaccatcgctttttataactttcaagagcccattttctattttccagccttttgcggggaaagtagagagtttagctcctctccatccgtcagttgtcttaccatcccataataggttccatccttcttttgcctcgttgggcgaaattgtattgacaatcagattcacttcaggtgcagataccggtgtctgataacgttctacatccgtcgtacaaatgcggatattcttccagctgactgtttttccttcatctgcctcatttttaatagcatgcacttgcaaagctataaatccggaaggcgacatatcatcccagatgttagcgcaaggcactccgtttatccaagtacggatagaattgccgacagcttcaacacgagccttattccatgcattgtttttgaaagcggtttgagctgacgggtttagcgtcagaggatacagccagcctctacgcgcttcatcgtagataccacccgaccaggctctttgggaaggatcaatctcaaactgataaccatgtacacgtccctttttaaactcctttttgctttcactgcgaagctgtacaccggaatttaaaccgtcatctatcttgaagtcaaattcaagaataaagtctccatagtttttggatgttgtcagaaaagtattgggagtccccattttagatatgccgacaatggcgttatccacaatcttatactcggctttgccgttcagtttcttccatcctttcagattctttccgttgaaaagaggttcccagttttgtgcacccaaagaagcggcgcagaataaaagcaacgttaatacgatattttttttcatctatttatgttattatgataataaatatttttgttatttcctgttgaatcagcactacagcttatagaactcatcccaacctttacgagggggaaggcccgtcaacattgcgttggcaaatgtattgtttgtaatctgctttgtgcgactgtcaaagaacagctgtgtgttgagtcgctgggccattacccccaatgagaacacctggctcaagacgccgttgatctcgaaaggcgagcgtgtcttttcaactccattacaagccaacaggaagttctcgaagtggttggaaggactttggggaacttccggcagtttacccgccatttctttggccttttcttcgggaataatagacagggtgcttccgtgactgccacctttgaaaatcagatctttggtataaatgatctttcccgggttcaactttgatttgggtgtattcccttgatttgttacaggaatgttcggatccagccctgaaactccataaccggcagggatcggagggagattgtccagaccgtcataccaggtaatatctaccggaggcattcctttacgttgcgggaagcggaagagaatcgtggaagaataagggaagaaataatcattgtgcccttcttgatactgtaaggtgacttcataaggtagtcccagttcaaggaactcgtgcactgtatccaggatatgtgctccccagtcacctaatgcccccattccgaagtcataccagcagcgccattgtccctgatgataatccttgttgtattcgtggtaaggaacagccccgagccaggtatcccattctaagtccttcggtagttgctgcccggcgggaagtttgtaaatgtttgtatcccatttgtgccaacggcgcggattgttcatgtgggcgtcgacagcagtcacatctttgatgatacctgcatccatccaagccttaaactggaaatagtttgcttcagagtgtccttggtttcccacttgagtagccaggttgggacgtttgagcgcggcctgcatcaacaactccgcttcatagaacgtacgtgcaagtggcttctccacatatacatgtttcccggaggccagagccagcatactgatcgggaaatgcgaatggtcgggagtggcaattgccacggcatcaaattcatttccgactttgtcaaacatctgacggaagtcccggaaacgtttcgcttttggatatttagccatcaccttttgcgtgtgtttggctcccatatctacatcacacaaggctactacttctaccatacctgtccgttcaaaatcgctgatgatctgtcccccgcggtttccgatgccaacataggctatctttaccttttcaccctttgcttttttggaggaaagagtttgagcattcagtacatcaccggctcccattgccaacccggcagaagccatcgacattgttttcaaaaaatctcttcgtgttaccattgtttcagttgtctttttataaaatcagatatttcattcatatagttgagtgcaacgtaattgtattcggcatgtcctctgtttttcatgatataaagcattgaatttgtatttccaatatctttcattcgttgttgaatggcatatccgtattttacactgattaatttatcccggtctccgtgaagggtaagtaccggaggtgagggagcagttataatttcaggattttctattgctccccatagattaattacagctttaattttgatcgttttcggttgccggacgtaaacagtgtgaagtgctgttatagcacccgcagatcctccgcagagtgctacggaatgagaatccaaatgatatttatctgcattcttttttaaccatttcaatgctttaacggcatctgccgaggcatcttcgatagatttttgtattaacggatgaaacttcttgtcagaagggagtccgttgctcatttgcgattggcatgaaagaccacttatcttgtggtacttcattcttaggtagtaatttatagagactacagcaaatcctctgtctatcattgctttacaaataggactaagacctgattttccatatttatctccacctgaaaaaccgccgccatggatgaagataaaaacgggaaatccattttgaggtggtttctgatttgggagataaatatctagtaatctgtcagaggaacgatctttgggagaaatatcacttcttgggtttccgtagcggatgtctttgatatatcgtcccggttctgtatatgttccgtctgctttcgttattccttgtgcaaaacaattggcggtgcacgttaaaagaataatgaatagagaggcagttaacctgggtttccatttagtgtttttcattgcatgatatttttttatattaaattgttgatttgggaattttaatttctggtaatagtttctttagaacggctgactggttaatgatacaaaagtatcccgtttcaaagacaatggcagtggcaaaaacgaaaatctatcttcaaaaagcgactgatttaatgcagtttgaagaactctctatgactatgtacacttttgataggaaaatgatcgcctataaaacgataaattgcaagtacattacttttcaggtatctgtcttgctttagttgttttggcctttttctcacggtattccagaggagaacaccctttgaatttcttgaaaatacgcgagatattgttatagtctttgaatcctgcgtctgttgcgatgtctgccaatgggcggttggtcgtaagtagtaagtctgccagatgatctactcggcaattcaggatatattgataaatagaagtattcatcgcatgtttgaatttcacttcaaagtttctgcgggataatggaatgttggcaagtaaagattctatcgtcaggtcggagctgtaatgtgaatctatatatttcactacttccagaatataagggtctttgatgttgtgtttctccgttgattggcgtagttcgatgcggatggggttgataacaatattgaaagtgcctccatgttctttctttatttgttggtggataagcctgccgatagaataacctcctctttctacttcaagctctatggatgaaatcggcgggtcggaaatattacacatcagttcatcgttatccacacccaatagagcgatttcttccgggatatgaatgttgttcatccggcaagtttcagaaatgaatagggcgtgcgcatcatcacaacaaaatagagcgactggcttggggagttgctgcaaccattgacttacttccattcttatctcatcttcctgcttatccgattcgaaactgaaaaattcgcctccgatgcgttttacctcctgccgataaccttcgcagcgttcgtcagaccagactactcctttaacaccgaaataagcaaaattgcgaaacatccgtttggcaaaaaactgggctgccattcttcccgttcctttatagtcgcctgtcagattggagtaagtgacgctccggtgatgatagttttgtagtactaccggaatattcagctccttctgcaaatcgatcgtatcattattccactgaccgataatagcgtcggctttccattctttcgcccatttcaaaatgccttgttcaccatgcattgcgctataataagaaggcagtcggtaaaagagccaggggccgttttctttggagtattggacaagtccccgtagcagtttcctgtcaaattcgcttgaatagtctatcaatagaagaatcttaatcatagttctatgtttttctttagtataatgtagggatgcacaaatatagaagaattcctttgttttcctataataaagacttaattttgtagcaagaaaaacttgtatgacacccgggtctcgtgctgtacgacacccgggtgttgttgtgttcgacacccgggtctcagtatgcatgacacccgggtgtcgtacaaattatgataactaacttaaaaagaaaggagcgtaagattatgtctatcccttatgtagtgagaaagaaagcggatttatcatccggagaacggaaagagttatggtatggtgtacctagtaaaatgcagcgaagaggaggagtgaaaaataaagaacttgcagtacggatggcaaagacaacaggctttcatcgtgggcagatagaaggaatcctgtcggagttggttgaaagtattcaagacctgctttcctccggtcattcggtgaccattgagggattgggaacctttcaaacggcactgaccagtcagggatgtgtgctgcccgaacaggtaacgccggggaaagttgctatttcacgcgtatattttgtggcaaactcaaaattcagcagggaactgaagaagacaaagtgtacccgcataccttttaaatattatatgcccgaaagtatgctaacgaaaaatatgaagaaagcagaccgggaactggaacaaacagaatacgacatagaagagccggaaatcgacgaatagttgaataaaaagcaatattgtcttgttaattgaacagaattagattatatttgttcagtggttagaacaatatcttgaaatatgattagaagagaaatactaaaagaagttctattagataatagaaatgaggtggtcaaacatcaagttatacctcgtagctttcagtttgaagagtttggaaattatgtatttgtaggtatccggcgagcaggaaaatcatttttactttatcaacggatacaggaacttttgcatgatgggcatacttggaatgaaatgctatatgtgaactttgaagatgaacgtttgattggaatgacggcggcagatttaaatcttatactggaagtacatgccgagatgtcaacagacaggccgatgcttttcttggatgaaattcagaatattgatggttgggacaagtttgttcggcgattggctgataataaatatagggcttatgtgacaggaagcaatgctaaaatgcttagtcaggatgtagctaccactttggggggacgatacattacagtacatgtatacccttatgattttaaagagtttctttatgctaatggggttgaagttacagagaattctttgtttgcaacagagagccgggcagaaataaagcgtatattcaatgattattttcgttccggtggttttccggaaggggcatcgcttgccgcaaaacgggattatctgacaagtgtttaccaaaagatatatttaggagatattgctgcaagacattccatcgaaaatacttttgctttacgcatcctttttcgcaaattggccgaaagtataaagcaaccggtttcgtttactcgtataactaatattgtagcttcaaccggagtgaaaatatcgaagaatactgtcattaactacatggaatatgccaaagatgcttgcttgctgattcctatacaaaatattgcggataaattggtggagcgtgaaactaatccgaaatattattttgcggataatggcattctcaatttgcttcttttggatgctgatacctcgttgcttgagaatttggttgctgtgacactattgcggcgttatgggacggacgatgctgtattcttttataatagaaatgtagaggttgatttttatttgcctgatacaggagtggctatacaggtctgttataccatgaatctctctgatgagactttccaacgggaagttcaggcattagtaaaattgaataaggtatttgaatgtcggcagttattgataataacgtatgacgatgaagaacggattgagttggaaaaatgtgcgattgaggtaataccggtttggaagtggttgttgggtaaataagataaattaataccctccctgtcttatttatgagataaatccctatctttgtggcactttttacgaaaaaagcaaattcaaattaatagatatagaaaagaaaatggcacaagaagacgtttttaagaagcttgtatcgcattgcaaagagtatggtttcgtattcccttcgagcgatatctacgacggactaggcgctgtgtatgactacggtcagatgggcgttgaattgaaaaataacatcaagaaatactggtgggacagcatggtgctgttgcacgagaacattgtcggtatcgactctgccatctttatgcaccctactatctggaaggcttccggacacgtagacgcattcaatgaccctttgattgacaataaagactctaaaaaacgttatcgtgctgacgtgttgatcgaagatcagctggcaaagtatgacgataaaattaataaagaagtagcgaaagctgccaagagattcggcgaatcttttgatgaggctcaattccgttctactaacggacgtgtgttggagcatcaggcaaaacgcgacgctcttcacactcgttttgctaaagcattgaatgatggtgatttggaagaattgcgccagatcattattgatgaagaaatcgtatgcccgatctccggtactaagaactggacagaagttcgtcagttcaatctgatgttctctactgaaatgggttctacttccgaaggagcgatgaagatttaccttcgtccggaaactgcacagggtattttcgtaaactacctgaatgtacagaagacaggtcgtatgaaagttccttttggtattgcacagattggtaaggctttccgtaacgagattgttgcccgtcagttcatcttccgtatgcgtgagttcgaacagatggaaatgcaattctttgtaaaaccgggaactgaacttgactggttcaagaaatggaaagaaatccgcttgaaatggcataaggcgcttggcttcggtgatgcaagctatcgttatcacgatcatgataaactggctcactacgcaaacgctgctactgatattgaattcctgatgccgttcggattcaaagaggtggaaggtatccactctcgtactaacttcgacttgtctcaacacgagaagttctccggcaagagcattaaatactttgatccggaactgaacgagtcttatactccgtacgtaatcgaaacttctatcggtgttgaccgtatgttccttagcatcatgagcgcatcttattgcgaagaacaactggagaatggtgaaagccgtgtagttctgaaattgcctgctgctctggctccggtgaaactggcggttatgccgttggtaaagaaagacggtctgcctgaaaaagcccgtgaggttattgacagcctgaagttccacttccactgccaatatgacgaaaaagatagtatcggtaagcgttatcgccgtcaggatgctattggtactccgtactgtgtaacagtcgatcatcagacattagaagataactgcgtgacattgcgtaatcgcgataccatgcaacaagagcgtgtagctatctctgaactgaataacattattgcagacagagtaagcatcacttctctattgaaaactttacaataaacctttgacgaatgagtaaaaagatctatttattctccttagtattgctggctcttgcgttcactgcttgcagtgaaacggaagagacgagtcgttatgataattggcaggcacgtagtgtggcttttatagactcgatcgctagtgtgtatgatagtcctaaaaatcaagctttggatgatgatgatccggagaaacttcatgcttttccagatccgacgaatagtcagactatatatgtaaagaagataaaaaaaggggaaggtacagaatctcctaaatatacttctacagtaagtgcacattatcgtatgtcttatttcaatggagatgtagttcaacagacttatacaggaacagagccaacagagtttgattctccgacaaattttacattgaatggtgttattcccggttggtcttatacgctgatgtatatgaaagttggtgatttttggactttgtatattccttatcaaagtggatatggttcaagcactaatgatggtaacctgcaagcttattctgcattagtatataatgttaggttagagaagattgtagagagataatcttataacaatataataaatatgaatataggtgttgggtctaaacgatgcaacacctatatttttcataataataaccgagttgccttcttagagattatgcaatatcgtttttctaaaagtatataaggaattattccttttgttttgttcctccttgcttaaattacagaagattacatttttgttttttttatactactctccctaatctgcaaatgtgtcggaatcgttacctgcttgattgtcttatctccttttatctgatcgataagtagttggcaggcagtttctcccattttataagtttgatgtgatacagcagataatttcggttccacataattagcatgctgctcgtctgtatacccgatgattgccacatcattcggaatccggaggccatggtttttgacgacttccattgctgcgaaagccaatgtgtcattcatggcaagaatagcatccggaggctgtggaagtgacagtaaagtttctgtggcaatcttgccttcctcataatcaatcttccggcagactaccagctctttttcgatcggaatacgattctcacgcaaggcttccagatagccatgttttcttctctttacaatatccagatgattagctcctccgataaaagctacccgtttacttccattatccaggagatgttgtgtagccatctgtgcggattgtgccccgtctgctatcaccgatgaaaattggtcggtcaggcaaacacggtcgaacaggataagtggcatattaatgtctttcaaggcggagatgtgggagaaatcggttgtttcttgagacagacaggcgatgataccttccacgcgcatattgaccagattctcaatatttcttttttcgtgctcgtaagactcatgtgaggtcgtgataatcacgaaatatccgttggcaatagccatattctctattccattcagaattgatgcaaagaaatgagtgacaatatccgggactaccactccaatgatacgtggcgcatttttccgcaggctcatggcaaaaggattgggacggtagttcatctctttagccagtgcctttgctttagtacaaagttcacggctgatttccggactatcttttagtgccctggatacagtaggaattgatccccccaatgcttgggcgagatctttgagtgaagtatgtttccggttttccatttgaaagtctgcaacttagattctttttacaaagaaagcacattcccggaaaattaagagcatctgaagcaatattttttacgtaaaccgttacgttggtttttcgaccgctctctgctgcactgaaactattactgacctatttttgtcgcatacaaaatgatttaaaacctaaaagtatgcaataccatgaaatcggaaagacagggatgaaagtatcatctcttagttttggagcttcttctttgggaggagttttccatgatttgaaagaaaaagaaggaattcaagcagtgtttactgctgttgaagcaggaatgaactttatagatgtgtctccttattacggacattataaagcggaaactgttttagggaaggcgcttaaagatcttcctcgcgaccgttattacctttctaccaaagtgggacgttatggaaaagatggagtgaacctgtgggattactctgcaaaacgtgcgacagaaagtgtatatgagagcatggagcgtttaaatatagattttatcgacctgataaatgtgcacgatgtggaatttgccgatttgaatcaggtagttaatgaaactctgcctgctttggtcgaactgcgtgaaaaaggagtggtaggacacgttggaattaccgacttgcaacttgaaaacctgaaatgggtaattgaccattcaccaagcggtacgattgaatctgtgcttagcttctgtcattattgcctgtgtgatgataaattagcagacttcctggactacttcgaatccaaagaaatcggcgtgattaatgcttctcccctttcaatgggactgttgagtgaacgtggtgttcctgcctggcatccggctcccaaacccttggtagaggcttgccgtaaagcaatggaacattgcaaagctaagaattatccgattgagaagctggctatgcagttctccgtcagcaatccccgtatagcaacgactttatttagtacaactaatccggagaatgtgaaaaagaacatcgctttcatcgaagaacctattgactgggaactcgttcgagaagtacaggagattatcggagagcagaaacgtgtaagttgggcaaactcataaaacagcgtcattcgtatggactatacaattattgatgcgcacgcccatctgtggttacggcaggatactgttgtggacggattgcctatccggactttggaaaatggccgttcggaatttatgggagaaatccggcaaatggttccgccctttatggtagacggtgtgaatagcgcggaagtttttctttcgaatatggactatgcgcaagtggctgcggctgtcattactcaagagtttattgacggtattcagaatgattatttgtcggaagtcgtttcccattatcccaaccgtttctttgtttgcggaatgtgtgagtttcgtaaacctggatttttggagcaggcgaaagagcttatagccaaaggttttaaggctataaaaatccctgcccagcgcttgttgttaaaagagggacgggtaatgctgaataatgaggaaatgatgcagatgtttcattctatggaagaacggaatgtcatgctttccatcgatttggctgacggagcaacacaggtttccgaaatggaagagattattcaggaatgtccccgcctaaaaatagctgtcggacacttcggaatggtgacacgtccgggctggaaagaacaaatccgcctggcacgtcatcctaatgtgatgattgaatccggcggaatcacctggcttttcaatgatgaattttatcctttcaaaggagcagtgaaagccattcgggaagcggcggatttagttggcatggagaaactgatgtggggatcggactatccgcgcaccattacagcaatcacctacaagatgtcatacgattttgtggtgaagtcttccgagttgacggaagaggacaaaagactctttttgggagaaaatgcccggaacttctatagattcacggatctccccgtacttccttacatcaagaacatgtccgaatgatagagaaaacatccttatcgtaaaactagatttataccatgaaaaagaatacatatacaatacctttagcgttggttttctgccttttctttctgtgggcgataagcagcaatctgcttcccacaatgatccggcaattgatgaagacatgtgaactgaatacctttgaagcctcctttaccgagactgcctactggttggcttattttattttccccatccccatagcgatgtttatgaaacgttacagctataaggcgggaattattttcggactggtattggctgcaatcggaggcctgcttttctttcccgccgccattttaaaagaatattgggcttacctctgtatcttctttattatcgctacgggaatgtgctttctggagacagctgccaatccgtatgtgacggttttaggagcccccaaaacagctccccgccgattgaatctggcgcagtctttcaatggactcggagcttttatcgctgccatgtttttgagtaagctcatccttagcggaactcattacacgcgagagacccttcctgtagattatccgggaggctggcaggcctatatccaattggaaacggatgccatgaaacttccttatctgatattggctatactgttgattgccatagctgttgtcttcgtcttttcaaaattgccgaagattggggacgaaggagaaacggcttcttccgataaaatgacttcttcgggtaaaacgaaagagggcagccagaaagaaaaattgatagacttcggtgtattgaagcactcacacttgcggtggggagtgattgcgcaattcttctataacggtggacagacggcgataaacagtctgttcctggtttactgttgtacttatgccggattgccggaagatacggcgactactttcttcggattgtatatgctcgcatttcttttggggcgttggatcggtaccggattgatggtgaaattccgtccacaggatatgctactggtttacgccttgatgaatattcttttgtgcggggcagtgatgatatggggaggtatgatcgggttatacgcaatgttggctatctctttctttatgtctataatgtatcccacgcagttctcattggcgctaaaaggactggggaatcagacaaagagtggttcggcatttctggtaatggctattgtcggcaatgcctgcctgccacagttgacggcttatttcatgcatgccaatgagcatatctattatatggcctattgtgtaccgatgatttgctttgtcttctgtgcatattatggttggaaaggttataaagtaatcgattaataaatttatttatcaaacatatccaatgaaagcagttcaaattgtcaatccctccgaaatgaaggtggttgaactggaaaaaccgaccgttggtgtcggtgaagtattagtaagaatcaagtatgtgggtttctgtggctccgacctgaatacctttttaggacgtaacccaatggtgaagttaccggtaatcccgggacatgaggtaggagcggtgattgaggaggttgggccgaatgttccggccggcttcgaaaaagggatgaacgtgacattgaatccatataccaattgtggtaaatgtgcttcctgtcgtaatggtcgtgtcaatgcctgtgagcataatgaaacgttaggggtacagcgcaatggagtgatgtgcgaatatgccgtattgccttggacgaagattattccggctggtaatatctctcctcgcgattgtgcgttgattgagccgatgagtgtcggattccatgcggtatctcgtgcgcaggtgatcgataatgaatatgtgatggttattggttgcggtatgatcggtatcggtgccattgtacgtgctgctttgagaggggcaacggtcattgctgtcgacttggatgacgagaaactggaactggcgaaaagggtaggtgcttctcatgtgattaactccaagacagaaaatgtacacgaacggatgcaacagataacggagggcttcggtgccgatgtggtgattgaagctgtcggcagtccggtcacttatgtgatggcggtggatgaagtcggttttacaggacgggtcgtttgcattggctatgccaaaagcgaagtagctttccaaacgaaatatttcgttcagaaagaactggatatccgtggttccagaaatgcgttacctgccgatttccgtgcggttattaattatatgaaagaaggcaactgtccggtggaagaactgatttcgaagattgccaaaccggaaggagctttggaagctatgcaggaatggacggctaatccgggaaaggtgttccgcatactggttgagttctgataagttcttgtaataagaatagttgttgatgcctgttgtttcgggtatgtaataagtgagaggaggctgaatacagtctcctctctttgggagatagggtgatgtaacatgagtaaatatagatgtaacattcttcattcgatatgtagcatcacaaagaaatcatgtagcatactttgggcaatatatctgtttgcattttctatttttgtgatgtggaagataacaagaaacattttaaataattagctttcaaataatagataatgtagccagttaataaaaaacgatgattatgctgaaaacaaaaatcaacactattctactgtgtactctttttacattgttctttccgctatcagccggagcacaataccgtaatcctattctttatgctgacgtgcccgatatgtcggtgtgtcgcgcaggtgattacttttacatggtttccactactatgcacctgatgccgggagcgcctatcatgcgttcgccggacatgaaacattgggaaactatcagctacgtatttccccgcattgacgatggtccccgttatgatctgctcgaaggcactgcttacgggcaaggacaatgggcatcatctatccgctatcatgacggtaaattctatgtatggtttacagccaatggtgcgcccggacgtgggtttgtctatactgcgacagatccggccggtccctggaaacttctttcgcgccccccgcatttccatgacggttcgcttctgtttgatgatgacgggcgggtgtatctctttcacagtacaggacagcttacggagttgaaacccgatttgaccgatgtacttcccggtggtatcaatcagcaaatatttgaacgggatgctgacgaacaagggctgttggaaggtagttccgtcatcaagcataatgggaaatattatttgctgatgatttctatggattggagtattcccggccgtctgcgtcgtgaagtatgctatcgtgccgataagattaccggaccttacgaaaagcgtgtcattcttgaaacggagtttgacgggcatggcggtgttggtcagggatgcatcgtagacgggaaaaacggtgaatggtacggactgatttttcaggatcgtggtggcgtagggcgtgtgccgtgtcttatgccttgtacatggacggaagatggttggcctatgctgggagacaaggatgggcacattccgaatgataccactttatcgtatatgtcaatggatggtatctgcggttcggatgatttttccgcttccgggctttccctctattggcagtggaatcataaccccgtcgatcaggcatggagtcttaccgaccgtcccggatttctgcgtttgaaaacctctcgtgtggtagataacctgtttgttgctcccaatacgttgactcaacgtatggtaggaccgaaatgtatgggcactgtcagtctctctctggggggcatgaaagatggtgaccgtgcaggattatcggcttttaatggtgacagcggtgtgcttacgattgaaaagaacggaaataaactgtctcttgtgatgagtgaacagaaaagtgtatttgagaaaacgaagcgtgccattagccgtgtggatatgaccgaacaagcccgtatacctcttaacaaagagcttgtctacttgcgtgtggaaggtgactttaccaatggacgggatgaggctcgtttttcttatagtcttgatgggaaagcatggatacctgtcggtctgcctgtcaagatgaaatttgactacacccgtatgtttatgggcagtaagtttgccatatttaactatgctacacgttctgtgggcggttatgtagatgtggactcttttgattattcgttctgtgatgcgtcaatgtaacacacaaatatgtatttgtaaccaatgaaacattgttttattggaaaataggctatttttgtttccaaattaatcataactaataagtataatattatgaaaagaggttggataccgattatgggtgtttgtttggtgttatcgttttcggcatgtaagcaattgctgccttaccaggacacttctttaacggcggaacaacgggcggaggatttgttgccccggttgactttggaagaaaaagtatcattaatgcaaaatgcgtcacctgctatccctcgactgggaattaaagaatatgagtggtggaatgaggcgttgcacggtgtgggacgtgccggattggctactgtttttccccagtctatcggtatgggagcttcttttaatgattcattattatatgaagtgttcaatgccacttccgatgaggctcgcgtaaaatcgcgtattttcggtgaaagcggcgtgctgaaacgctatcagggattaacattctggacaccgaatgtcaatatattccgtgaccctcgttggggacgcggtcaggaaacttatggtgaagacccttatctgacaggacaaatgggaatggctgtagtccgtggtttgcaaggaccggaagatgccaggtatgataagctgcacgcatgtgccaagcactttgccgttcattcaggaccggagtggaaccggcatagttttgatgcggagaatatagatccccgggatttatgggaaacctatctgcctgcttttaaagatttggtacagaaagcgcatgtaaaggaagtgatgtgtgcctataatcgttttgagggagagccttgttgtggcagtaatcgcctgttgatgcaaatattgcgggatgaatggggatacaaaggcattgtagtctctgactgtggagcgatttccgatttctatagaccgggaacgcatgagactcacccggataaggaacacgcttcggccgatgctgtgcgggcaggcacagaccttgaatgtggaagtgaatatgcttcactggcggatgctgtaaaagccggtttgattgacgaaaaagaaatagatatttcattgaaacgtttgttgacagcacgttttgaactgggagaaatggacgaacaaccggcctgggcggaaattccaacctctgtgttgaatagtaaggaacatcaggcactggctttgcgtatggcccgtgaatcattggtgctcttgcagaataaaaacaacatcctgcctctgaatacccatctgaaagtagccgttatgggacctaatgccaatgactccgtgatgcagtggggaaattataacggtattccggcacatacggttaccttattggaagctgtccgtgccaaactaccggaaggacaaatcatatacgaaccgggttgtgaccgtgtggacggaaagacactccaaagcctgtttgatgaatgtagcataaatggtaaacccggtttcttggcagaatattggaataatcgtgatcgtgaaggggaagtggttgctaccgatcagatttccactccgttccattttgcgacaacaggggctactacgtttgcgcccggtgtggaaattactaatttctcggctcgttatgaatctgtctttcgtccttcgcagtcgggtgatgttgctttccgtttccaactggatggtgaagtgactcttattataaatggtgagcaagtggctcagaaaatatatgttaagaatccgacgaacctctatacgttacaggcgaaagctggaaaagagtatcatatcgagattttattcaaacaacggaatgaaagggctacacttgattttgatttgggcaaagaggtcgggatcgacttgaacttcgcagtgaagagagtaatggatgctgatgtgattctttttgctggtggaatttctccaagtctggaaggtgaggaaatgccggtagaagttcccggatttaagggtggtgaccgtacggatattgaacttccggacgttcaacgtgatttgttgaaagctttgaagaaggctggtaaaaaggttgtctttatcaattattccggttcagctatcggactagtgcccgaaacgactacttgtgaagcgattctgcaggcatggtatccgggacaggcgggtggtacagctatcgttgatgctctttggggagagtataatcccggtggacgcctgccggtcactttctataaggatgtgaatcaattgccggactttgaagactattctatgaaggggcgtacctatcgatatatgcaacagcaaccacttttcccattcggtcatgggttgagttatactacgtttacttatggagaagctaaattgagcaagaatacaatcgcgaaaggtgaaaatgtagtattgactattccggtaagcaatgtcgggcaacgtgatggagaagaggtggttcaggtttatttgagacgtccgggtgataaggaaggtccccgttatactttgcgtgctttcaaacgcgttcatattccggcagggaaaactgaatcagtagctattcctcttaccggtgagaactttgaatggtttgatgcagagtcgaatacgatgcgtccgttggaaggtacttatgaattactgtatggaggaacttctgatagaaataagttgaaaacgattgtaatgaacgtacagtaataccgctttggaattttgtttatttttacagatagacaatccggatttatttattgaatgaataaagaaagaacgaccttgttcctttaaaaggaacgggtcgtttcttttaaaccaagcctccgtttcttttaaaccaacgggggctttcctttaaaggaaaatgaatatttgctaatatttgatattcagtcttttacatgatggggaataaaagtgctgaaataataggtaatgtagttatttatcttaccatttttctgttttgaggctttttgttacatcagaaaagaatcatgttacatgtctgtgataaatgtaacctgtatatagatgcctgtatcatgattgtacatatatgataaaaccgaatcgatacatttgcaaacactactatggaacaggaaattatagaaaataaaaagtgataatatgagaacattaaaattgattttgtcgggctggcaatccgtgggtcttgtcgtattttttatgctgttttttaatatggaggtgagtggtaagggtaaaataacaaaaaatgctcctgtctttacgcaatttatttatcagggggaggatgctatttatcaaaacaatcctttaaagccgggtgagttctataatcctattttgcagggttgctatcccgatccgagtataacgcggaaaggtaatgattattatttagtgtgctcatcttttgctatgtttcccggggtgcctattttccattctaatgatctggtcaactggaaacaaatcggtcatgtgctggacagaacgtcacaattaaaggttgaagattgtggtattagtgcaggtgtatatgctcctgctataagatataatcccaataatgatacgttttatatgataaccactcaattttcaggtggctttggaaatatggtggtaaagacaaagaatccggagaatggctggagtgatccgatcaaactacaatttgaaggcattgatccttctctcttctttgatgataatggcaaggcatacgtggtacataatgatgctcctgctcagggagaagaacgttactcaggacaccgtgtcataaaaatatgggattatgatgtggagaatgataaagtggttccgggaacggaccggatcatagtaaacggtggcgtcaatatagaagaaaagccgatatggattgaagctcctcatatctataaaaaagatggacgttattatttaatgtgtgccgaaggaggaaccggaggttggcatagcgaagtcatttttgtaagtgatcatccgaaaggaccttatcttccggcaaataataatcctattttaactcaacgttattttcctgcaaatcgggcgaataaagtagactgggctggtcatgcagacttagtggagggacccgacggaaaatattatggtgtatttttaggaatacgccccaatgagaagaacagagtgaataccggacgcgaaacttttattcttccggtggactggagcggaacatttcccgttttcgagaatgggcttatccctatgaaacctacattgaagatgccttcgggagtagagaaccaaacaagaaaaaacggttatttgcctagtggcaactttgtctttaaggatgatttctctgataaaacattagacttaagatggatcggtcttagaggtcctcgtgaagatttcgttgatatgaccgataaagggttgcggatcatcccttttacctcaaatattaatgaagtgaaacctacttctactttgttctaccgtcagcagcataatcaatttaccgcggcagcaaccatggagtacaaaccaaaaaatgagaaagattttgccggtataacatgttatcaaaatgaaagatatcactatgttttcggtatcactaaaaaggggaaagactattacctgatgctgcaaagaaccgaaaaaggacaagcgagtgtcctgggtgaggtgaagatagaaacagagaaacctgtgacactgcaagtaacagccaatggagatgattatcgttttaattattcgattgatggcaagagtttcctaaatttaggaggaaccgtttccggcgatattctttctactaatgaggctggtggctttacaggagcaatgattggactgtatgcaacatctgttggttattaattagaaaccttatcattctataattatgaaaatacatcatctattttggggtatatgtttatgcttcagcacaaatatcttattcgcacagaactatcagaaaacatcgtccggtatcaaaaccactgtaaatgcagtggatatagaagtacaattctttgcgcctgctgtggcgagagtaataaagtcaccggaaggtgttgcctatgaaaaacagagtctttctgtaattgccaaacctgaaaaggtgagtttcaaagctgatatacaagataataagattgtattgaataccagtgaactaagtgtcagtgtggacaccgggacgggaattgtttcttatttctcaaaggatggcaaatcattattggcagagaaatccggtatgcagtttatcgatttcgatgatgccgggacaaaaacttatcaggtttatcaaccttttatattagataaggaggaagccatttatggtttgggacaattgcaaaatggaaagatgattcagcggaacatgactaaaaatctgatacagggaaatgttgaagatgtgtcacctttcttccagtctactaaaggatatggtgtgttttgggataactattcgccgactctttttacggacaacgaagttgaaacatcttttcgttctgaagtaggtgattgtgtagactattatttcatgtatgggaaggatgccgatggtgtaatagcacaagtacgcagcttgaccgggcaagcaccgatgtttcctttatggacttatggttactggcaaagtaaagaaagatataaaagccaggaggaagtggtagacgttgttcgtaaatatcgtgaattgggtattcctttggatggtattattcaggattggcaatattgggggcataactatttgtggaatgcgatggattttcagaatccgactttcaataatcctcaaaagatgatggaggatgtccatgcgatgaacgcacacatggctatatctatctggtcgtcattcggaccgatgaccaaaccttatagagaattggacaaaaaaggtatgttgtttaacttcactacctggccgcaatcgggattggagtcatggccccccaacatggaatatccttccggtgtaagggtgtatgatgcttacaatcccgaagcacgtgatatttattggaaatatctgaatgatggaattttcaagctgggaatggatgcctggtggatggactctaccgaacccgatcatctggattggaagccggaggatatggataccaaaacctatctgggctcgttccgtaaggtgcgcaatgcttatccgttgatgactgtcggaggggtttacgaccatcagcgtgcagtgacttcggacaaacgcgtgtttattttaacccgttccggattcttggggcagcaacgttatggtgcaaatgtatggagtggtgatgtcgcttccacatgggagagttttagaaatcagattcctgccggattaaacttttctttgtgtggtatgcctcactggaatagtgatattggtggcttttttgcaggacattataataaaagctggaatgatgatagtgcttcaaaaaatccattgtatcaggagctttatgtgcgttggttgcagtttggaacgttcaatccgatgatgcgttcgcacgggacggatgtttatagggaaatctataagttcggaaagaaaggcgagcctgtatatgatgctatcgagaagatgataggtttacgttactctctgttgccttatatttattctacttcttgggaggtaagcaatcgtcaatcgagttttatgcgcgctttgatgatggattttgtagatgacagaaaggtgtgggatatcaatgacgaatatatgtttggaaaatcgatccttgtggctccgattactcatgcacaatatacaccggaagctgtggtaaaagtctccgaagaagaaggatggaacagagatggagcgaaaaaaacaaaaactgacgttgctgtggatttcatggaaacgaaatctactaacatatacttaccggcaggaacgctatggtatgacttctggacaaacgagaaacatgaaggcggaaaggaaattaccaaagagactacactggatgttattccattgtatgtaaaagcgggtagtattattcctgttggtccacaagttcagtatgcaactgaaaaaccgtgggatcatcttgaactgaaggtgtatgcgggtgcgaatggaaacttcattttatatgaagatgaatttgataattacaactacgaaaaaggcgtttatacggaaattccaatctcgtggaataatacatctcgtaaattgacgataggggcaagaaaaggtgcgtatgagggaatgttgaagaaccgtaagtttactgtaactcttcaggacgggactcaaaaaaacgtcgattataatgggaaagcgatttctgtaaagttttgattgtaatagaatgtgtgattatatcagtagaaaagaatctaaaaagtagaaatatgatgaagttttttatagtaatggctatgctattggggagtagcgttgcaagtgcagaaaataaacagataacaagtcctgatggaaagctggtagtaacagtttcagatgtggatggaagaccttcttattctgttagttatgacaatgttctttttttgaagccatctccattggggatgattgcaaatataggagatttttcatcggggatgtcgctggagaagaatgtttcaaccaataaaatagatgaaacatacgagttagcttctattaagcagagcaaggttcgttatgtggcaaatgaagctgtattttcgtttacacaacaagggaaaacaatttatgatgttatatttcgcataagtaataacgatgttgcttttaaatataagatatatccgcaaggtgagacactaagttgcgtggttaagcaagaagtcacaggatttgcgtttcctgacggaaccaccactttcctttgtccgcaaagtaaaccgatgggaggatttgcccgtacttctccaagttatgagacatcttatacagcagatgatgtcgcagggaaaaatggctggggagaaggatatacatttccctgtctgttccgtaatggagataacggttgggtgcttgtttccgaaacgggagtaaatggtggatattgtgcgagccgtctgttgggacacaaaggaggagtgtataccattggatttccgcaagaaggtgaagcaaatgggaatggtacggtttctccggggatagcattaccgggcgagacgccttggcgtactattactgtgggcaagactttggctccaatagtggagacaacggttccttttgatgttgtaaaaccgctttatccggcaaaaggagagtatacgtatggacggggttcatggagctggattatcggtatggatggaagtactaattataaagagcaactccggtatattgatttttcggcagcaatggggtatcagtccgtgttggtggatgccttgtgggataaacaaataggacgtgaaaaaattgaagaattggctaaatatgggaaggacaaaggggtagctctttatttgtggtataattcgaatgggtattggaatgatgctccgcaaactccgagaggtattatggataatgcgatagccagacgtaaggagatgaaatggatgcaaagcattggtattcgtggaataaaagttgactttttcggaggtgacaagcaaatgactatgcagttgtatgaggatatcttgtcggatgcaaatgagtacggtcttttagttattttccatggatgtactttgcctcgtggctgggaacgtatgtatcctaacttcgcatcgagtgaggctgtattggctagtgaaaatcttcatttctctcaaggcagctgtgatcatgaggcctttaatgctactttgcacccgtttattcgtaatactgtgggtagcatggattttggaggtagtgcattgaacaaatattataatgcggataatgctccacggggaagccggcgggtgacatcagatgtctacgcactggctacggcggttctatttcaaagtccggtacagcattttgctctggcaccgaataacctgaccgatgctccatcgtgggcaattgattttatgaaagaggttccaacgacttgggatgaggtacgtttcattgacggttatcctgggaaatacgttattcttgcccgtcgtcatggagataaatggtatattgccggagtaaatgcgcagaaggaaacactgaaacttaaagttaatttgccgatgttctccaatggagaaaaggtaagactgtttagtgatgataaggcattgcagggcggtgtgaaacaaatagaaatagggaagaaacaagaattacagttggctattccttgtaatggtggagtattaataaccagataaccatttaaaataaaagaatatgagaaacttaaaatttttaggcgtgtcgtttttgttggcaatgactgctgctacttcgggggtggcacaaaatcctattatccagacaaaatataccgctgatccggctccgatggtatataatgataccgttttcctttatacaactcatgatgaggatgatgccgaaggattcaaaatgttggactggttactttatacttccactgatatggtcaattggaccgatcatggagcggtcgcttctctgaagagttttgattgggtgaaacgtgataacggtgcctgggcagaacaagtcatcgaacgtaatggcaaattttatatgtattgtccgattcacggtaatggtattggcgtattggtctccgactctccttacggtccttttaaagacccattgaacaaaccgttggtttggcagaaggagcattggtatgacattgacccgaccgtatttattgatgatgacggacaagcgtatatgtattggggcaatccgaatgtttattatgtgaaactgaatgaggatatgatttcatattcgggggaaattgtacaagtggaaaataaaccggaacattaccaggaaggtccgtgggtgtataaacggaacgggcattattacatggctttcgcttcaacttgttgcccggaagggattggctatgccatgagcgacaaagctaccggaccatggagtacaaaaggatatattatgcgtccaacagagcggagtagaggaaatcatcctggaattatcgattataaaggtagctcttatgtatttggcctaaattatgatttgcttcatttggaaacattggatcataaggaacgtcgttccacgtctgttgcaaaaatgcattataatccggatggaactattcaggaagttccttactggcaggagacgaaactggaacagattgaaaactttaatccttaccgtagagtggaagctgaaacgatggcttggggatatggtcttaaagctgaaaatcataagaatggtggtttgtatataaccgatattgatgataatgaatatctgtgtgtgcgtggtgtcgactttggcaagaagggagcaaagaaattcagtgtaagcgcagcttgtgttgaaaaaggcggaatgatagaaattcgtctggacagcactgaaggtccggtaataggcagtgtcagtatatcaccgacaggaggactggatatatataaacagatgtcatgccggataaagaatgcaaagggtgtacatgatctttatttctgctttaaaggagagaaaggaaacaaacttttcaatctggattattgggaatttgaatagcttttattcaaaaaaaataagattgtaatgtgcttataatcagtgtaattattagggcgtgctacaaggggaaagatagatgtaacattgaaaatgaagatgttatttaggaaaagaagcccgtaacataattatgtttgtagttttataagctggcatatctttgcagaaaaagatcagtaattcatatttgattataaagaaaataagaggtattatgaagaatacacaggtaatacaattaatgtcaatcgtccggctctccatatttatgttggggataacaatgatgtcatgtaactcaaagaaagaacaacaattaccggctattggaaaatctgtggctctctttgattatttttcttataaaggaaatgatgatttttatatttccaatcctctgtcagatgaagactatttctataatcctattttgccgggatggtattctgatcctagtgtttgcacaaatggagaaggtgattatttcctggtaacatctacattcacttatttccccggtgttcctatttttcacagcaaagacttggtgaattggaaacagatagggcatgtgttgaaccgtgcttcgcaattagtgaatatggaaggacagaaagtgagtggcggtatttttgctccggctatttcttataatccgtataacaagacatattatatggtaacaaccaatgtaggagccggaaatttctttgttaagacgcaagacccgtttggtgaatggtcggaacctgtcatgttgccggaggtcggaggtattgatccttctttcttttttgatgaagatggtaaggcatatattgttaataatgatgaggctccggataataagcctgaatatagcggacaccgtactatacgtatacaagagtttgatgtgaaaacagataagacggtcggtccccgtaaaattcttgtaaacaaaggagctcaaccggcagacaaaccaatttggatagaaggccctcatttatataaaataaatggaaagtacttcttgatgtccgccgaaggtggaacgggaaactggcactcggaagtgattttccgtggtgattctccgatgggtaagtttcttccatggaaaaacaatccgattctgacgcaaagacatttgaattctgaccgtcctaattcggtaacctgtgctggtcatgcagacttgattcaaacaaaagagggagattggtgggctgtttttctggcttgtcgccctattaataatcagtttgagaatttgggacgtgaaacatttatgatgccggtgaaatggagtgaagacggattcccgtacatgacacaaggcgatgatttagtacctatgattgtaaaacgtgaaggtgtgaaacgcgatacgacagttacttatggtaatttcgagttagtagagaactttgattctcctgtacttgatatgccatggatgactttaagaacttctgcatccgatctatattctttgtcggaaacacccggatacctgaccttgaagtgtgcagatattagcgctacggaaaagaaaactccggcatttgtttgtcgtcggttacaacatcataaatttgaatgtgctacacgtatgttgttcaatccttctaacgataaggaaacagccggaatgctgttgtttaaagatgagacacatcaatatttcttctgcttgaataaagtgggtgagaataaaaatatttctctgaaacaaatcggtgaaaaggaacagacattggcttcagatgaaatagacgcagatacaaatgaagtatatttgaaattagtatctcaaggaattggttacgatttctattattctattgatggtgaaaaaagctggaaactgctttgtaaagatgtagatcccagttatctctctactacaacggctggtggatttaccggtactacaattggattatacgctacttgcaaataattattttttttatataaatctaatactagtaactatgagtgatatttataatgatagctaatgcaattaaaaaaagaatgatgattagaaaacaatgtagttaattaacatcttaaactaatggtaatgaaaaatgtaacgaagaaaattcaaaaaattccttacctgtttctccttatgttgtttagttttgtaacagcatcagcacagaaagggataacggtgaggggaacggttcttgacagtaatggtgagacaatcattggagcctcggtaactttaaaaggtaataattcagtaggtacgatctcagatatagatggcaattttgtgttgactgtgcctagtgagaagtccgtccttattgtttcgtatgtaggaatgaaaccacaggaagtgaaagtatcttccaaagggatgataaaagtgacgttggaagatgataccaaacaactggaagaagtagtagttgtaggttacgggcaacagaagaaagcgtcagtggtaggtgctatcacgcagacaagtggcaagacactggaacgtgccggtggtgtaactagtcttggttcagcattgacagggtctttgccgggagttattacttctgcttcttctggtatgcctggtgcagaagatcctcagattatcattcgtacacagagctcgtggaataatagtgaacctttaatattggtggatggtattgaacgtgagatgagttcggtagatatctcgtctgtagagaatatttcagtgctaaaagacgcctctgctacggctgtttatggtgtgaagggtgccaatggtgtaattcttataactaccaaacgtggtaaggaaggaaaagctagtgtgcaaatcaaagctaatgtaacagcaaaggtggcatccaaactaccggagaagtatgatgcatacgatactttttatctgttgaataactctattgaacgcgaggcttgtcttaatcctaatggctggaatgactatactccgacttccattattgataagtatcgtcatcctgccaatgcggaagaatgggatcgttatcctaatactgattgggaaaaagcactgtttaatagtacagccatgtcttacaataccagtgtcaatgtttccggaggtacaaaaattgtcagttattttgcagcggctgattttgtaagtgagggtgacttgtttaaagtatatgataaccgtcgtggctatgattatggttttggctataatcgtattaatgtgcgtagtaatttggatttccaattgactaaaactacaaagttttctaccaatctatttggatcgaatgctcagcgtaccgtaccatgggactataatgaccaagatgcaactttttgggcagcagcctataaaagtgctcctgatgccatgcgtccgatttattctaacggtatgtggggatggtatcaacctcgtgatgccgatgtgcctaactccgtatacaaactggctgtagcagggtcggagaaacgtacgactacaaagatgacttcagattttatccttgagcaagatttgcatatgcttaccaaagggctgaaattcaaagctaatttctcaatggactatacattcgttgagaataagcgtggcgtcaatgatatgtatcataattctcagcgtatgtgggttagacctgatactggagaaattattttggaacaaccggagcttggtaccggtttggatgctattatcaatcctatctattgggaacatcaggctggtagcgtgaatactggtgctacttatcgtaagctttattattccatgcaaatggattatgcacgaaatttcggtaaacatgaagtgactgctcttgctcttttcagtcgtttgaaagaagcgtcgggcagtgtgttccctatttatcgtgaagattgggtgtttcgtttaacttataattatgctatgcgctacttcttcgaaactaatggtgcctataatggttcagagaagttcggtcctgattaccgttttgcttttttcccttctttttcattaggatggatgattagcgaggaaaaaattgttaagaacaacctgaaatttctcgatatgttgaagttacgagcttcttggggtagagtgggagatgatgcggtggttcagccttggcaaagatttacagatggtcgtttcttatataaaaatcagttggattatggaggtaacacactaatgggtaatattaagcctgccaatactccttatacttactacacaatcagtcgactggggaatcctaatatctcatgggaaactgtagaaaagagaaatttaggtattgattatgcttttttaggaggggcggttgccggttcggtggatatattcaatgacactcgtactgatattttagtgaagggaagcgatagagcgatagcttcttattttggaactgatgctccttatgctaatctcggtaaagtgagcagtcatggttatgagttggagttgagattgaaccatacttttaataatggtattcgtgcttggctcaatactagcatgactcatgctgtcaacaaagtgaaattccgtgatgatgcacctttgaaacctgattaccagaaaggggcgggacatgccattaatcaggtatattcttatattgatcatggtaatcttgctacatgggatgacgtgattggaagtccggtttggacaacgggtaatgatgcaaaactccctggggattataacattgtcgattttaatggcgacggtgtaattgatgctgatgaccgtgctccctatcagtattctacgatgcctcagaatacttacaatgcttcaatcggagcagaatggaagggatttagcatttttgcacagttctatggagtaaacaatgtgactcgtgaagtcaatttcccgacgttccgtagcactgctcatgtagcttatgctgaaggtgattattggactcccgatgggagtgctactctgcccgcaccgcgttgggggaccactattgatcaagcagcatcaggcactagatattggtacgatggttcttatttgcgtttgaaaaacgttgaattgtcctatactttccaaaaatcaaactggttgaagaagatggggatcaaaaactgccgtatatatctgaacggtgataatctttatatgtggactaaaatgccggatgatcgcgaatctaataccggatatagttcttctgatggtgcttatccgacaatgcgccgtttcaatcttggtatcgacattactttataaatactaagtaaagactatgaataagtatattaataaaatattccttacgtcggtcatcactttggccggtatgttgggagctacttcttgtactgactatttggacaaatctccatatagtgacattgaagagaatgatccatataagaatttcaagaatttccagggatttaccgaggaactctataactgtatacctgttgtatcaaacagtgagtatcatactagttttaattttggtgaggaagattattgggagccacaggagcttcgcctctttgcccgtaatattgactatggtgatttctggggatggactacctgttattattcttatccttcttctatacgtggtggaaaggctaattcacaggaacgcagtgataagggtaatctgtggaaactttgctggtatggtatccgtaaggctaacattggtatagctaatcttggtaatttggtaagtgctacagaagaagaacgtaatcttattgaaggacaactttattttttccgtggatggtttcattttatgttgatggaatggtggggtggaatgccttatgttgaccaagtattaccgccggatgttgctcctgcattatccaggcttacctggcaagagtgtgctgaaaaatgtgtggctgattttgaccatgctattcctttgcttcccgttgactgggatcaaacaactgctggtagagctactcttggtttgaatgatactcgtattaataaaattatggccttggcctataaagggaagacattgctttgggcgggtagtccgctaatgaactgggcttccggaggtgacaaagagtatgatgcgggacgttgtaagcgtgcagctgaagcttttggcgaagctttgaagattgttgaggatactaaacgctatgaattagcagatatggaaaattataacgacctgtttgtcgtatacaattccggcggtaaacttaacggggtgaaagaagctatcttccgcgaaaatttagtgcagtatgatggtcgttggaactataacatgaatacggattttcgtccgcgttctcatatcaatgctggtattaaatgttatccgactgctaattatgtaaattattttggtatggctaatggctatccgatcaaagatatgacaaaagccgatgcagaatcaggatatgatcctaagtatccttggaaaaatcgtgatccgcgtttttataaagacatcatatttgacggtgaatggtgtggagaaactggaaacggacaatattgccagttgtatacgaatggagcggacagtgaagagaaagatccacagaaagggtgttttacaggttatatgaatagtaagctctgtctaaaaatagtgaataatgctaacgtcagaggtgctcactacgctgttttaagtttgatgcgtttagcggatgtttatctgatgtactcggaggcaacggctgtaggttatggctctccgcaaagtaaagcttctagcttctatatgacggctgaagatgctatcaatgagattcgtgatcgtgccggtgtggctcacgtacttgatcgatttactggaaatacgacagactttcttggtgagattcgccgcgagcgtgccgtagaacttgcttttgagggctttcgctttatggatctccgtcgttggatgcttcttgataagagtccttataccttgaagacaaagattgagtttgaccgtgtccctaccgcaagctataacaaagagcatccggaggagaatgaaatcatgaacttgaaagaagtggtactggtggagagaaagtataccgacagacactattggctgccattacccaaagcagatgtttacttgtatgaaggctttggccaaaatccgggatggtaatcatgacgtattaactaataatgacgcgaaatatgaatagaaagtttatatatatcggctgtactgtttttgccatgtcattgcttagcatgacaggtgtgcaggcacaggaggaaagcaaggacagcttagtgaatgtggctttcggcaaagttgctcaggaagatttgactcatgccatttctactgtcaacacgtcagagctgacaaagaagactgctaacaataatagccttgtgggccttgaaagttttgtcggtggttacaatggatcatccctttggggacaaggaccgttggtactggtagacggtgtgcctcgtagtgcatcaagtgtaaaggcttcggaagtggaaagtatatctatgctgaaagatgcggcagctgtggtactctatggtagccgtgccgcgaaaggagtaattcttatcactaccaagcgaggcaaagattcacccatgcatatcgatgttcgtgccaatgtaggggtgaatgtcccgaaggcttatcctaagtacttggatgcagattgttatatgaccatgtacaatgaagcttgtcgtaatgacggtatagcagaaaggtatgatgccggtactatttataacacagcaatgggtactaatccttatcgttatccggacatagacttttatagttcagattatttgaaaaagttctatactaattcagatgttacgggtgaagtgtatggaggtaatgaaaagactcattattacttgaacttcggtatgaattatgctaatagcctgttgaaatacggtgagtcaaagaaagcttatgatatgagttttaatgtacgtggtaatgtggatatgacactggctccatggcttaaagcaactactaatgctgctattatctttgacaatagttatcaaggccgtggtgacttttggggagcggcttctacattgcgccccaactggtttgcaccattattacccattgatatgatggatcctaatgttgcatatatacaggaatatataaccaacagcaatcatcttatagacggtaagtatctgttaggaggtacttcggcagacacgacaaacccgttttccgaattgcttgctgctggatatacgaaggaaaaagcacgtagatttatgtttgatgtggctgtgatggcggatcttggaggcttgttaaagggcttatctttcaaaactgcttatagcgtagattacacttcttattattcagaagcttatgctgaaaagtatgctatttatgagcctaaatggtctaatgtgaatggtaaggatatgattatcggacttaccaaattcaatgatgatacaaaatcaactaacgaatatgtaggtaaatcgacttacgaccagaccatgactttcagtgcacagtttgattataaccgtacatttaagacattccataatgtatctgcgaccttgttgggatggggatatcagacacaaagttcggctgatgaaggtcatgagagtagtgattatcatcgtaccagcaacgtaaatctgggattgcgtgcttcttataattacgatcataaatattatgcagactttagtggtgctttggtacattcagccaagctgccggaaggaaatcgcaacgctttttctccatcggtcactttgggatggagacttagtaaagagaagtttatggaaagtgtaggctttgtggacgatctgaagattacggcttcttatgccaagttgcatcaggatcttgatatttctgattactatatgtataagggctatttttctgacaaaggcggttggtttcaatggtatgacggaacggtgggtggtaatacgaccggttcaaaacgaggtgacaatccgaatcttgactttatcactcgtgaggaagttcgtgcaggtatagacgccactttattcaatagactgttgagaattaatgcgaactattttactcagaagactagtggacttctaactcaaggtgcttctactatttatccttcgtttttcgatttaggcacagatctttcatttttaccttggatcaattataatgaagacaaacgtactggttttgatttttcactaagtgcaaataaaaagattggtgatttcgacgtgactctcgggtttaatggaatggtattttcttcaaaagcttctattcgtgatgaagtggcgaatgagtcttatttgttgcgccaggggcgtgcacttgatgcaacttatggatatgtttgcgaaggtttctttcaagatcaggctgatatcgagaaacatgccaagcagacattcggcacagttcgtcccggtgacctgaagtataaggatatcaatggtgatggtgtaatcaatagtgatgaccagattgatctgggtgcaggcgggtggtctacatcaccatttacttttggtttgaatttgacattgaaatacaagaactttactctttttgcaatgggatcgggacaaaccggtgcggtggcttttaaaaataattcttattactggaacagaggtacgagcaagttctcagaaatcgttatgggacgttggactgaagaaacgaaagaaacagctacttatcctcgtctttctaccagcaatggtgataataacttccgtaattctactttctggatgtacaagaataatgttttccgtttgagtaatgtgcagcttacttatgattttcctacagatactttcaacggaacttttatacgtgggcttagcttgtattgtggtggaagcaacttacttacaatagcaaaagaacgtgagtatatggagatgagtttgggggctccccaataccggaatttctatctaggctttaaggccgcattctaaatctaactaaaaaagatagtacataatatgaaaaagaaaataatatttttggtagctgctgccttgatgctgaatagttgtgatgaccttttcgagccggccatcgagaacttcaaggatgtggaacagatgtacgacgatgctcaatatgcacaaggcttcctggtgaatgtgtaccgttgcgttccgggatactatgataatagtgaatatgcaacagatgatgctgtcattaatcagaagaacaatgcatttctcacgatggctaccggtggttggacttcccggttatggacgcctatcaatcaatggaccaattcgttcagttctatccagtatatcaatcttttcctggaaaatgtggataaggtaaggtggtcggatgatgcagagaaagcacaattgtttgctcgtcgtaccaagggggaagcttatggacttcgcggtatgtttttatactatttgcttcgtgcacatgctggatttggagaaaacggagaactgctcggtgtacctcgtttgacggagtatcttactataaactcggaccttaatttacctcgtgcttcgtttgctgattgtgtacagcagatatatagtgacttggaaaaagccgaagaattacttccttgggagtataatgatgtgaatgaggtacctgccgattttcagagtattactcaggataaaggtaaatataatactgtaatgggagagaagtcccgtcagttattcaatggtctgattgcacgtgcttatcgtgttcgtactgctcttttggctgctagtccggcttttcaggatgcctctaatcctgcttcatgggccgatgctgctaatgcggctgccgctgtactcaactacaatggaggattgggcggattggatgataaaggagtggaatattattcaaaagaagtagtagagaacttgcaaaaaggcattaatcctaaagagattatttggcgtgaaaatgttagtaatagtgaggctgccaactcacaggaggcaaataactttccgccttctttgaatggtagtggcaatatgaatccgtcacaaaaccttgttgatgcgttccctatggctaatgggtatcctatctcggacattgctaacagtaactataatgagaataatccttataatggacgtgatcctcgtttggcaaaatatattatctataacggaagtgtagctggagtaggcgatgtacctatatatacagggcgcaaatcgggcactgatgacggtatagatgtgaaagagcagagatctacacgtaccggttattatatgaagaaaagactgcgtatggatgtgaatcgtgcgctcggatcggttacgaatcagcagcattatattccacgtattcgttatacagagatgtatttggcttatgctgaagcagctaatgaagcgtggggacctaaaggagataatggaaatggttattcggcttatgatgtaatcaaggctattcgtaagcgtgccggtataggcggtacttctgatccttatctggaacaatgtgcgggcgatagagacaaaatggctaatcttatccgtaatgaacgtcgtctggaactttgttttgaaggtttccgtttctgggatatacgtcgttggaaagaaaacttgaacgagccggtacgtggtatcgactgggacagagatgggcattcttttaatgaattcgttgtcgaagaacgtaattatgaagattacatgtattattgcccgattccaaattctgaaatacttaagttcagcaaccttgtacaaaatagagggtggaaataattatagaattatatttaattaaaagtacgttatgaaaaagaacttagcatatatcggactggttttattgatccttacttggacgtcatgtgaaagtagtgacaatgaatttcctgatttcgattaccagacagtatattttgccaaccaatacggacttcgtaccatagagcttggtgagagtgaatttgtggataatactcttgacaatcagcataagatggtaataaaagctgcttggggtggaggatatactaatagaaacaatgtggtgataaactttaaagtggatgagtccttgtgtgacaatctttattttaaagatacagatcagcctcttgtccctatgccggcttcttattacacgttggcttccgatcgaattgcgattcctaaagggcaaataatggcgggagtagaagtgcagttgacggatgatttttttgctgatgaaaaatcgatcagtgagaattatgtcattcctttgttgatgactaatgttcagggggcggactctattttgcaagggaagccggttgttgaaaatccggtgttaactaatgccagtgattggagcatattgccacagaattttgtcttgtatgcagtgaagtatgtgaatccttggcacggagagtacttgcgtcgtggcattgatcatgctactgtagcaggtacatcaaaagatattattcgccatgaacagtttgtggaaaatgatgaagttgtgaatatttctactaagagtatgaaagacaatcttttgacactgaaaaccaaagatgaaagtggtaaggatattagctatactgttcgtttgtcatttgcagaagatggttcgtgcactgtacactctggttcgcagaatgtagtggtaagcggtagtggcaagtttgtcagcaaaggtgagaaaaatagtcttggtggaaaagacaggaatgccatttatcttgactatacagtcaatttgacagacaataacattcagcttgcaacaaaagacactttggtgttacgtacacgtaatgtgtatggtggcaagtcactcgaagtagtgagaaaatgatgttttgatatgaacgttaaaatcaagagtatatgaaatacatcaataacaagataattgcttttacactgatcgctgcgtcgataatgtcgtgtacagacgaatatgattgccagcttcaagtagagaaaccacagaatgcagctatcaacgaatatttagctcaatttgacctgctgaagtcgtatattgaccgtagtggtacaccttttcagttggctgtaaatgtaccgggaagcgaatttgtaaagaaagaaattgcattcagtacagtgtttaccaattttgatgcagtggatatgaacggttcttacgatccgctaaatgcactaaaggaggacggtacttacaattttggtggcatgcaaacggctgccgatgtagcggcggaggctggtgtgactctttatggaggggtactttgttcaaaccaaggacagcgtgccgcatattataataagcttatcgagccgatagatattccggtagaagtacaaaaaggaacgactaagttgtttaatttcgaaaatgatgctatcggtacgacttatccgatgacaggtaatagctcggctacagttgaggaagaccctgccggtgaaagcggtcatgttttacatgtgggaacaaatgatgtgaaagctgcttattcctatcctaaatttcacgtagttttgcctgcaggaagaaaactcggagactacgttagattgaatatagatttgcgttttgtaggaactgatgggatttggggacaaggtttacgagtcttgatcaatggaacggagtttaatgtaggaaaaaatggagatggtttctgtgacggaggtgacaaatggaaacgtgaaggaacaattaatctgaaagatgataccgctcccggattggtagtacccgaaagtttaggaagtctgacagaatttgatttagcgataggttctgcatccactagtgcacaattttatatagataatatttctatggactatgaagtatcaggaaaaggtaccacggttatcaattttgaaggggatgaactaaataaaacctatcctatgactaatggtgcaacagccactgtagtacaggatccagccaacgagagtggtaaggtactttttattgatcatgcagcctattcattcccgaaatttacagtaaaactaagcgaaggtaagacactaggagattatagcggtatgtctatggatatgcgcctcattgcaggtaaatatggtggtggaatgagtgtggtaataaatggtcaaactttccctcttaagcagaatgcgttagcatatggttgtgatgacaataatacgtggaaacgtggaggcatctatgtgacctttgtaaaggaaggtacttacccgaagaaggatgaagttccagctactataattgaaatacccgatgcaatgaaagacctgaatgagatagaattttcaattggatccagttctactaactggacagcatacatcgataatttgatttttacatgggaagccaagccgcaacatatcgaaaagactccagaagagaaaaaggaaatcttcactaaagaaatggaaaaatggattggtggtatggtgtatgcaggtgtgaatgaaacgaagagtgtaaaagcttggaatataattggtaatcctttggataagactgttaatgataatacatttaactggggtgaatatttgggtgaagtagactatgcacgtaccgccgtgaagattgcccgtgatacagtgaagaatgccaatgtagatcttgagctttttgtcagcaacacatttggtcaatatgatgaaatggggaatatggctgatgaactcatatctttagttgatgcttgggaagcagacaacgttaccaaaattgacgggtacaatattcttctcaatgcaatttattccaaagatgttgttttccaggaaggcaataaaacgatgatcaccaatctgtttgataaattaggtaagactggtaaactgatacgggtatccgatcttagcatgatggttgaagaactggatggcaactttattgcgattaataaattaacagaagaagatagagctgccgctgcttcttatatggcttttatcatgcaggagtatcgaagacttattcctgcagacaagcaatacggaatctctatatcgggtattacagagaccaatactggttataaactgtgtccttggacatcggactataaccgtaatgaaatgtatgaaggtatagtggacggattgaaataatcctctcctctggattaaaaggactatttatatatgaagaatattacattattattttgtctctttcttgcgaatatcctcttgggggcttgttcgggaggggaagatgaaaaaaaagaaatggatgaaggaaagggcgcgtatgcgctctttcttaaaaaatccattactgtgagtactggggaaagtcagacggatgttgtggtggaatgggcgaagacttcttgggagataattcttggtgaaggggatattgtaaaaagcgtcactcctacatcaggtggcagtaatactggggaaaaacagtacacgaaggttcgtgtatcttgtggtgcgaacagtacgatgaaaaagcgtacacaaaccattcacttattcgataaaactaatgaaacaactgttgatttgctggtagaacaagaaccgccattcaagtcggttacactaactgttgatccttcggtgaaatatcagccggttgtaggatttggcggtatgtacaatccgaagatctggtgtggtgacaatcttatttctgcaccacaattagataaaatgtatggtgtcggcggattgggatattctatccttcgcttgatgatttatcccaacgaatcagattggagtgcagatgtagaagcagcaaaggcagcacaagctaacggagcaattatctttgcatgtccatgggattgtacagatgcgcttgcagataaaatcacggtgaatggaaaggaaatgaaacaccttaaaaaagaaaactatgaagcgtatgcaaaccatcttatccgttatgttacatttatgaagggaaaaggggtgaacctctatgcgatttccgtccagaacgaaccggatatggaattcacgtactggactccttctgaagtagtggattttgtaaaacaatacggagcaaggatacgggaaacaggagtgaagctgatgtcaccggaagcctgtggtatgcagcctgaatatactgatcctattatcaacaatgccgaagcatttgctcaaacggatattctagccggacatctctatcaagggtttacagatttgagtagcggatatgttaagaaccgccacgattacatctgtggtgtgtattcacgtattcaaggaaagacatggtggatgacagaacatctttttaatgacggtgagaattctgatgattcttcgaaatgggaattcctgaaatggcaatacagtctcaatcatcttggtaaagagattcacatgtgtatggaggggtattgcagtgcttatatatattggtatttgaagcgcttttatggtttgatgggcgatacggacaaacggagtccgacgagtgaaggagaaatcacaaagaatggttatattatggctcattatgctcaatatgcaacagaaacaactcgtattaaggtagttacaaataatgaagaagtctgtgctactgcttatttggatgaaaagaccggtgaagtgaccatcgtattattgaatctgaatggtgcttctcaatggctggaaataccattagcaggaataaaaaaagcaagtgccgttgaaacgaacgaaacaaaaaatatggaagtgatcgatactggtttgatggaatctgctgaaggtataacggtgttgttatctgctaacagtataacttcagtcagattgacatttaaatgataataataactagttggaatatgatgaatttgttaaatacgaaaagtaagctatcatacctactttttctcggaatagtatgctgtgcatgtattcttggttcctgtaaagatgacgatgtcattgatcctgacgctccttccgtaccgaaacccggtacggctgtcgagaatattaatactaatgtcaaggcattacgtaagcttattgaggccaaacaacaggacctggctgtaaagacatacaatccggtgaataatggcgcgagttatacgattgagttgtcggatggtacaagcttcagtatgtatgctcagatagcagcattggaaggcggaggagaggatgtagtttattctccaaaagtaggtgccaaagtagaacatgatgaatattattggactcttgatgatgcctggctaacgtttgagaatgatgaaaaagtcaaggtgttggatgaaaacaatacagttgcaccgatagtagatatcaacactgacggctattggactgtaaaatacggagctaagtctcgtacccttgacaaggcggtgagcggcaaacttaccagtcagtttaaacaagtgagtgctattggtgacgaatctgtcagtttcacttttaccgaccggacacctgtcatcgaactgaatctttttaaaggagataatcccgaaattcctccggtaacgggggcgttacgccgtcctatttctcctgaacaaccggcatggtttgttcatatcgattcatggaattatgccgatcctcagaaaatcatagaccttatccctgcagatattcgtccgtttaccatttttaatatctcgttgtctgtaagccatgatgaggctactgggatctataatgtaagcgagtatggttatgagatagcaaagtcgtggttgaggacgtgtgctgaaaataatgtgtgggcgatggtgcagccttcaagcggcggttttagtcattttaaggatgtcagcttatacagtcaatttgaaagtgacgataaggttcgggtatatgatgagtttttcagagaatatcccaactttcttggtttcaattattgtgagcagttttgggggtatgatgaccagttctctgtatcgtggttacaacgagtggctcactggaatcaacttttgaaacttactcataaatatggaggatatctggtagttagtttttgtggtaatacttggtcggctaatatcaatcctattgctcttgtgaagcgtaattctgattttgcccaaactgccaagttgtactctgaaaatttcattatgtgtgagaaatacaccacgcaaagtggcttctttaatgtcgaaggaatttgcttaggcacgtggctctccggttttgcaggtcagtacggtatccgtttcgaccaatgcggctggacagaggagaaaggacagaatggcgataaggatttcccaccggctgccggtgcgctgcctattatagagcatgtgatgctgacaggtcagactgttatcgacggacctgaacttatatggcagcaatgttttaaggagacaaatgtagtcagtgtaggtgatggttatcagagccgtaattgggaatgttttccgcaatttgtcaatatcaatatagatatgttccgtaagattattgataaaacaattcgtattccttcccggaaagaagttattgaccgcacgaaagtggtgattcttcaagatgtctattccggtgatgataatgctaaatacagcagcccgaagaatttgcatgaagggctttaccttcgcgatgatgatggcaatctttgggataatcattgttactttaagaaaacgggccgttatcctacgattcctgttgcgttcgaattgtgtgacgatgtagctaattcattccagtataaaatcaaccaatcaactttcgaaggatcctggagcgatgtaaatactaaagttggaaaattcaaccgttggttcccgcaagagtatacgggagaactttatgcaggacgtatagaaaatggttgggtggtttataacggacttgccggaatacggaatgctgcaattccgtttaaatacaatacatgtgacaagatggaattggcttactccaaatatactgtaagtgttataaaagaatatgccaataagctcaccttctacatgaataactatgaccctagtggttcgagcaagacggaggtaatcaagatatatggatgtacatccaaaccaactcattctgtgtcttccagagccaatggtactgcacaagtttccgagaattggaaagaagatgtatatacgctgactgtcactcataacggaccattggatttgacggtcaattgctcaggaaaagccatcgatcgtttaactgtatctactgcagcatctatccagattcccgcttctccacaaatttatcagggcgcttatcagtatgaggctgaatgctttgattttaagaatgtgactaagagagtgacaaaaggagattcggagccgatacgtaactacacagcacagggatatataaactttggtgctagttctgcagctgccgtacgtgatgctgttactgcactggaagatggtgtatatacaattcgtatccgctatcgtgctccgtcggctacagtcaataccgtagatatgtatataaacaataccaaagtaggtactccggagtttgcacaaactgataatgacaatactgtatggaatacagccttaatgtcggtttccttacgaaaaggggcaaatacgtttgaattgaaagccaattcatcaggtgccggtgacttgtatctcgacaacattgttatcgaaagaaaataagaattctcttaaattcgattatccgcattttacaagtagtatcttgcggataattgtttttaggacagtatgtaactagaaaataatgaagaacatgtttttgagtcggataataattatatttctattcttatgtgtatctgttttgaatgctgcggaaccatttgtcacttttatatcagcggatgccaagttacctttggttacaccacaaaacagatcgttctctatttggtgtgatgatgcagaacatcgtggggtgctgttagcggtgcgtaatttacaaacggattttgaaaaagtgactactgtaaaacccgaattatcgaatattgcgggaaaagaagtgcgtattatcataggttcgtttgacaaaagcccacttatacgtcaattagtaaaaacaggaaaactggatggtaaagaattgagaggtaagaatgaaaaatatataatcaccactcttcatgctcctttggaaggtttacagggagatgtgctgctgattgctggaagtgataagcgtggaacgatttatggtatttatgaattgtcaaaacaaatagggatttctccttggtactggtggcttgatgttccgccggtaaagcatcaggctatttatattaaagaaggtgtttatactgatggtgaaccggctgtaaaataccgtggcattttcattaatgatgaatggccttgtatgggaggttggacaactgaaaagttcggaggatttaacagtaagatgtatgtgcatgtctacgaacttctcctccgtttgaaagctaattttctatggccggccatgtggagtgcagcattttatgcagatgatccgatgaatagtcctttggctgatgaaatggggattataatcgggacttcccatcacgaaccgatggcacgtaatcaccaggaatatgcccgtaatcgtaagttgtatggtgagtggaactatcagaggaataaagagggagtagaacgttttttccgtgagggtatcaagcgaatgaatggaaaggaagaagtaattactatcgctatgcgtggtgacggtgatgctccgatgggacccgatacagatacgcatctattggaggatatcgtaaaaggacagcgtaaaataatagcagatgtaacaggtaaacctgcttgtaagactccacaattgtgggcactttatagtgaagtactggaatattatgataagggaatgaaaatacctgatgatgtcatgattttgctttgtgatgataattgggggaatgtacgtcgtttaccagatttaaaggataaacggcatcctggtggatatggtatgtattatcatgtagatttacatggagcaccacgtgcctatcaatggctgaatatgacacagatccagcatatgtgggaacaattatatttgacttattcttatggtgtggataaaatgtggattctaaatgtgggtgacttgaaaccgaatgaatttcctgttgattttttcttgaatatggcatggaatcctggacaccttacggctgataatttacaggaatatacttgtagtttctgtaaacaacagtttggggataactatgcagtagaagccgctcgcatcttaaatctgtattgtaaatatgctgctcgcgtaactgcagaaatgttggatagccaaacttataatctttccagtggagaatttaaggctgtaacagatgaatttcttgctttggaggcgcatgcctatcgtcagtttatgactttaccggaagaattgaaggatacatataaagaactcattctttttcctgttcaggccatggcaaacctttatgagatgtattatgcggttgctatgaatcataagttagcatctgagggtgatccacgtgccaatgaatgggcagatagagtggagtattgtttcaggtatgatgcggaactttgctatgactataataacaatatagctggtggaaaatggaatcatttaatggatcagacgcacatcggttatacaagctgggatgagcctaaaggaggaaatataatgcccgaaatcataagagtggatgtctctgcatataagccgggaggatatgagtataaggagaaaggtggggtggtagtaatggaagcggaacgttttgcagaatgtacacaagggaataagacggagtggacagttattcctgacttgggacgtactctttctggtttgtcgttgatgccctatacacaacctgtaacaggagcttcattgacatatcgcatgaagcttaattcagagatgaaaaatatacgtgtaagattaatcttggatagtactttgccttttataaaaggaggacatagttatgctatcagtttggatggtggtaaagaacaaatagtaaattacaattcagagatgacttgggctaattgttatacgaagatgtatcccgccggtgctgcgcggttgatagagtcggtggtagatttttccaatgttaatctgaaagaaggaatacatgcattaattattcgtccgttaagccctgctattgtattgcataaaattataattgattgtggtagtgatgaagtcagtcgattgaatcttcaggaaagtccttatcgcaaggttacgcattaattaatatttatgatatagatacgcaaatgaagaagattattgtcttaagttgtttattatgtgcaggcatatttgcctttgcacaagaccctaatttccatatttatctttgtctgggacaatccaatatggaaggaaatgcaaagattgaagcgcaggatacgtgcaatgtcaatgaacgctttctgatgatggcggctgttgattgtccgtctttgggacgtgtcaaaggacagtggtataaggctgttcctccgttggtacgttgccatacagggttaacaccggccgattatttcggacgtacgttagtggaaaggttgcctgataatattaaggtaggtgtcgtcaatgtagctgttggtggttgcaggattgagctgtttgatgaggagaattgcgaagagcatattgcctctcaaccggaatggctgaaaaatacagtgaaagcgtatggtaataatccttaccgtagactaaaggaattggctgtagaagcacagaaagcgggtgtgattaaaggtatcctcttgcatcagggcgagtctaataccggtgataaagagtggcctcaaaaagtaaagagagtctatgagaatctgttgagggatttgaatcttcaggcaaaagatgttcccttgttggcgggagaagtggtgcatgccgaccagaatggcagatgtgcaagcatgaatgagataatcaatacgctgccgcaagtgattccgaccgcatacgtgattccttcttcgggctgtcctgccgcagaagataatttgcatttcacggcagaaggatacaggaaattgggagtgcggtatgccgagaaacgactccttttgttggagaaggaactaaactccgggattactaccgaaccggtatccactaatattccgggatatgactatccccgggtggataaagaggggcgtgctcattttcgtttctatgctccgcaggctaacaggctacaagtggattgttgcggaaagaagtatgatatgtggaaagatgccggaggactctggacggcaacgaccaaccctctgcctgtaggattccattattatttcctgattgcagacggggtgtcggtaacagatccttccagttatacgttcttcggttgttgccgtatggcaagtggcatcgaaatccctgaaggtgaggagggggattattatcgtcctcaacaggtacctcacgggcaggttcgttcctgtacgtattactccgaaacgcagagagagttccgtcggtgtatggtatatacgccggcagagtatgaaactcatccgaagaagcgctatccggtattgtatctgcaacatggcatgggtgaagatgaaaccggctggagcacgcagggaaagatgaatcatattatggacaacctgattgcatccggtcagtgtgtgccgatgctcgtggtgatggatagcggtgatgtggaagctccgttccggccgcgtccgggaaaagatgtgaacgaggagcgggctttgtatggcgccaccttttatgacgttattctgaaagacctgattcctatgatagaccggacattccgtacgaaaaccgaccgcgaacaccgtgctatggcaggactctcgtggggaggacatcagactttcaatacggttctgcctcatctcgataagttttcttatatcggaagtttcagcggggcgattttcggtctggatatgaagacttgttttaacggagtgtttgcggatgcggacaagttcaataagaaagtgaattatttctttctcggctgtggcacggaggaacaaatgggaacaaagaagatggtggattcactccggaaactgggtgtcgaggttgattattacgaatcgcaaggcacagcgcatgaatggcttacgtggagacgttgcctgaaagaatttgtaccacatttatttaaacactgaaaatagcatgaaaatgaaatctacatttatcgcagctacattgttgctcgtttcggttatgaccgaaggaggactgtcagcgcaaaacccgattgtgcaaacttgctttactacagacccggctcctatggtgcacgacggcaccttgtatgtgtatacgggacacgatgaagacaaagcggattttttctggatgcaggaatggcgtgtatattctaccaaagatatggtgaactggaccgatcacggctctcctcttgccatcgaatcattcgactgggcggacgaccgtgcctgggcagcacaatgtgtagagcgtaatggtaagttttattggtatgtctgcctgcattccaaactttccaatacgatggcaatcggtgtggcggtaggcgattcgcctgtcggtccttttaaagatgccatcggcaaaccgcttcatgacggaagctgggactatattgatcctacggtcttcattgatgatgacggtcgtgcttatctgtattggggaaatccgaatatctattgtgcagaattgaatgacgacatgatttccttgaaaggtgaagtgggcaaactggaacagactgttgagagctttggtgcacccaatccggaaaagcgtgtcaaaggtgttaagtataaagatacttatacagaaggtccatggcttcataaacgggaaggaaaatactatcttctttatgctgccggaggtgtacccgaacatattgcctattccatgagtggcggacctcttggtccgtggaagtatatgggagaaatcatgcctttacaagatacgggctcgtttactaaccattgtggagtgatagactataaaggcaattcttatttcttctatcatacgggtaagctgccgggtggtggaggcttcgggcgaagtgcggcggtggagcaatttaagtataacgctgacggcactttcccgattattaatgctacccgggaaggggtgtcaccggtaggtacgctcaatccttacgaaagggtggaagctgaaacaatcgctttttctgaaggtgtgaagtctgaaccaaatgtgaaaaccggtatatatatatctgaaattcataatggagattatataaaggtacgtgaagtggatttcggcaataaatcccccaaacggttcactgctaccgttgccagtgcccttcgtggcggaacacttgaagtacgtacagacagtataagcggaccattaattgcggaactgactattccttcaacgggaggttgggaatgctggaaaacattgcagactgatattgtaaaaccggtcacaggaatacaagatatttattttgtattcaaaggacgtaaaggctgcaaactgtttaactttgattggtacaagtttaacagataaacatgctagagagcagttgggttactcttcttttttactcaactgctctttcatatacattgaaggcggcattccatacaattctttgaatgttgtcgagaaattattaggatcagtgaatcctgttaacatggctatctcggatatggtatgctgtttttcggacaataaacgagcggcttcttttaaacgtatattacgtataaagtcacgggttgtctggttggtgagctctttgagtttcctgtgaagatgtacgcggctaatacctacctcggtggtgattgtctctattgtcaagttagggttactgatgttttcattgatcactttcataatacgttccatcaatttctcatcgggtgatttcacttccagtttctgaaccttgttttccagattttgctggcctgtaaatactttgcgtaactgctgccgtgtattaatcagattttctaccgtcttttgcagaatttcgatattgaatggcttcatgatataggcgtcggctcctgtattcagaccttcaaggttgtcttcttccctcgtttttgcagtaagcaaaatgactgggatatggttgaggtttacattctgcttgatcttccggcataaggtaagtccgtccatttcgggcatcatgatgtcactaatgactaagtccggagcctttttaaatatttgctctaatgcttctttaccattacggctttccatgatatgaaatttgtccccaaactccttcgctatataatttcggatttcttcgtcgtcttctacaattaatacgcgatatttagtttttaccctgactttcttttcttccttattttctataatgggagagatgacaggaacagttggtacggctactgttaccttttgctcattgttgtcaacttcttcaggtcgtagatgcttgttacccaacggtaatcggataataaaacggcaacccggttgttctttattattttctacatagataattccatgatgtaattccactaatgaacgagtaagatgtaatcctattcctgttccgcctttcggattctgttggctgttacggatctgatagaaacgttcgaagatatgttctttttcctgttcatcgatgcctgttccggtatccgcgataattatttcggcatattgtttcaagggatcgggcagtgtattatcttctcccgtacggatggtaatatctatgtttcctttttcaggagtaaacttgaaggcattagacagaatattcaggataatcttatcaaaattacctgtgtctacccatacattcagttcccggagcgtactgtgaagttgtagccggatattttttgtatttgcctgttgaccgaacgttgtacataaatcctctataaaaggaataatattggtctcccggaacatcaggaacatttgccctttatcaattttccgaatatccattagttgattaacaagattcagaatacgttccgcatttctgtagataatatgatatattttcaggcgttcattgttctcctcattcttaatcagtttctgtagagggctgatgattagagacatcggagtgcgtatctcatgagagatgttgataaagaactgcaattttgcttcattgatttgttcggcatggatatgttgcagcatttcctgatgcattctgtaccgatgtctgatctgaagaataatgataaatataatggtcagtaataataaggaatagataactttggcccaccatgaagcataccatgcaggagatataaagatggtaatttcttttatatttgaatacacggtgttgtcttttgctctgattttaaagttataggtaccgggtttcagattgctgaatgagatacggtttacacctttgggcaaactaatccatttttcatcgttgatagaataaaggtagttgatgtgttcgggggcatttaattccagagtggcaaactcgatactgaacacattgtctttatgggatagataaaactcttttgcgttgaatacagggcagttgataatattgtgaataccggatttcattccttttctaaccggattgttatgcaggaaaaagtcggtaatccggatattccatgtttttgccggattgataatgtcttgcggattgaaataggtgataccattcattccgccaaaccagataataccttgtttatctttgaaggaggcattcttgtagaactcatttccctgtaatccgtcgctgacataataattgataaatttgttgtttttcttttggaattgggaaattccggcattggtgcttatccaaagaaaatcttttccatctccttgtatggcatatattgtattactgggcaatccgtctgcagtagtataagtggttagttctttcgtatttttattccaaccggataatccttcggaactgcccaaccagacaactccttcgtcatcttcaaagattgaataaataacattttgtgagagtatcttatgactttgaaaatcaggactgtcaaggtctatacagttgatgccgtcataagttccgacatacagtttattatcatcggaatagtgcagacaacctatccattcgttgattagagatgtccgagattgtatggatgtaaattctttcgttttcaggtcatagtagaacaaaccgaatcccattgtcgcaatccaaagacgcttgtttttatcttctgcgaaatcatatacacgttgtatatagttgttgttcttatctaccagtttgtactggtaatcgcataatcctgtctgtttgttcagctttcccataccgtttataaaggagccgacccaaatgttgtactcggaatcttcatatagttttataactgttgaaggcacagaattagggtgattagtatgcgagaaatgtttagccggttctaacttttctgtcagggcataaattccgtcattgtctgttccaacccataacataccgttgttgtctttgcagaatgaggttatacaactggaaccgatcatgtttttatccatggatttatgtcctatatacttgaaactgtttgttcgggcaggtatctgcatgactcctttctgataaacagccaaccataagttaccggaattgtcttttaggatagaatgtatttttgaattttttgaatcaaaatagttgttgtcaaaattgtattcggagatttcatgagtttggttattgtagacactcatacctttaccatcagttccgatatataattcattttgcggtccggaatagaggaaacagataggaagttctctcttttctttaaaatcaataggtataaaggagtcttgtcttttgttatagacgaatagtccttttctcatacttcctacataaatattcccacgtgaatcttcacatatacttttgacatatccgttgtctttagataaatataaagtaagttggttattagaatcaagacgatatactccttcttcgtcttttgctatccagacattctgtttcttgtcttcaatcataaatcctgttgatgtcatggggatatcaattttttgaacagtcaacaggtaatctttgatattcaacctgcacaacatatttccggatacccatatttctccatttctcctttcgataaaggaaacaatattactttcaaatatttctccattgtcttcccttattgcaagtggggtaaaattgtctgtggccggatcatacatttgaattcccatatatgtaccgataaacaaatgacctttgctgtcctcaaaaacagtacgaacaaaattgtgggctaacgaatgttcattattgggctcatgtttgtatatggtaaatttagcaccgtcataacggttcagaccatcttctgttgcaatccaaatgaaaccgttccggtcttgatatatttgattaatcagactactggagagttctttgtcagtagtgaataacttaggagattgcccgttgcataacaaagaaaacaataataatagaaaagtgaatacatttttcatagttatagatcgttgtttgttgtacaaagaaaactaaaaacctaaatataacctaataaaaaatgaatattttcattaggctccgggagtacaatcgctgaatgtagtagaatgtaagttcatacttttgtgtcggacatttgctaaatatgggtgtgaaattataaagcaatattttataaatgtaatatatatgaagaacaattatttttcaagatgtgtgctgctagccggattatgttcggttattatggtttttgcagtcactcctgtttatgcgaccggaggtgcattttctcctcttccacatgctgtctctgaaggagacattactgttaccggtaaagtggttgatgatgccggagaacctttgataggtgttagtattcaagtgaaaggtactagtaaaggtgctactactgatgtgaatggtatttatacactaaatatagcatcaggttctacccttgtattctcatatatcggaatgaagaccattcaacggaaagtgacgaaaggcggtaagctggatatcacgatggagaatgatgagaatatgttggacgaggtggtagctgtaggatacggctctatgaaacgttcggacttgacaggatcggtcgtttccatcaatgccaagtccatagaagaatcaatggcttctaccattgaccaggcgttgcaaggacgtgcggcaggattgcagatgacgcagaattccggtgttccgggtggaggtacatctattcagattcgtggtgtgaattcattaaacagtaccaatgaacctatttatgtagtagacggagttattatctccggtgaaacaggctcgaatacaagtaatgctatggcaggtattaatccagctgatattgaaagcattgagatcttgaaagatgcttcggctactgccatttatggtgcacaggcggctaatggggtcatattgattacgatgaaagctggtgtaacaggcaagcctcgaattaacttccaagcctctgtgggaaatcaggaaataccgaaaacaatcgacatgatgaatttgcgtgactatgcccgtcattataatgaactatatgctcttataaatgccagcagggtgaaagatgcgtttagtcatcctgaaactttaggtgacggtactaactggcaggatgagatattccgcaatgctctgttgcagaactataacctgtcaattcgtggcggtacaaaaacggtcagctataatctgtccggcggatatttggggcaggatggtatttgcatcggttcggattttgagcgttacaccttccgtatgggaacagagatacaggttactcctaaggttcgtttcggaggtacggtgaatgtttcttataccaagcaaggtacaggcatggctagctggtctatcattcccaatgcactttatcaggcaccggatgttcccgtacgtgataagaatggtaacttttccggaccggaagaggacgaccagcagaatttaagcaattacagtaatccggtggcgttggcagcgttaacacagcgtaataatgaaaagggaggtgctcgtgccaatcttttcatgaaaatcaatccatggaaatggctgacttaccgtactgattttacggcagacggcaatatcgataattatcaatatttccttccccaatatgaattgggatactcaaagaatccttatcctactaatgaacactccaaaaactacgggctttactggggatggaagaatgtagtgacgatggagaagacgttcaaacgtaagcacaagacgagtttgatgttaggacatgagatgacttccagaagttcagattatcttcagggaaaacgtacacatggtgataatctgctgacagacttggatgcaggtgatgctgcgtatgccaccaatagtggaagggcaagcaagacaacgtacctctcttatttcagtcgtctgttttatagttacgacaaccgttaccagttaacggctacggtacggcgcgacgggacatcccgttttgccaaaggaaatcagtgggggacattcccatcagtagctgtggcatggcgtctttccgaagagtcattctggcgtccgctgaaagatgtggttaataacttcaagttgcgtttgagttatggtgaagtcggtaattccaatgtcagtgcatttgcttaccaacggatgggaacgtatgtgcagtctatctgggggacgagtttgcagaccgccaatattgctaatcccgatttgacatgggagagtacccgttcctggaatgcaggtatcgacctgaacttttttaataaccgtgtcgagtttattctggatgcatatatcaaaaagacaagaaacctcttgttgcaacaagattatccgggatatatgggaactacgggcaatggtgctgcaacagctcaatgggcgaatataggctccatggagaataaaggttttgaatttacattgaacacggtaaatatatccaatagggattttcagtggcgtacaaatgttacattcagtttgaaccgtaacaaggtagcaagtatgaatacagagaatgcctttatcgacaagacttatcaaaatagtggtcagacggaagtgattacccgcactgcagtcggaaagcctgtcagccagttctatggctataaggcaatcggccgcatcaatagcgcttccgattatttgatagataatggtgatggaactagcacggtaaagattgctactccagtattgcgggtaggtgaacaggtggttaactcgggtacggataaaggtagccttatcaaacaaatttatattggcgattatatttttgaggatctgaataatgacggagtgattgacgaaaaagatcagacattcttgggaagtccgttgcctaaatttacctatggcattaataatacctttaattataagaatttcgatttgactatattcttatatggttcgtatggaaacaaagcgatgaactatttgtcccgtcgtattactaaccccaattcgagtggtaatgtacacgcgtccgttgccaaccatgcccgtttgggataccttgatggaaattcggataataccgatgtctggaatatgtatatattgcccggctctaacggtttgtgccgtatgtctgttaatgatgccaatgataacgaccgcatcagtagccgttatgtggaggatgcttctttcttgcgtatacagaatattgctttgggatatacgttaccgaagaattggttgaaaaaactgaagatagagaatgcgcgcatttatgcgaatattaaaaatgtatatacattcacaggctatgacggttacgatccggagattggctctacacaggcgcaatattcttattccggtcagagtatgctgatgtacggagtggatacgggacgttgtccttctccccgtatttatacatttggtattgatttaaccttttaaatagaaaacttccatgaaaaagaatattatattatcagtggtttgtggaatggtcgcgatggcaagcctcacttcctgcaatgacttcttgcaagtaagtgccaccaaccaaaaagaaatggacaaatcctttactacttatgacgagctgcgtttggcaacagcttatctttatatgaaaccttggtttggttttcacagtacccgtctgtttgcgatgggagatgcacgcggaaacaatatctatggtgacaacaacaacgagacaggttatgctccttattgcctctttaccgacaaacccaatacacccggacttgccgatgcgtggaattcactttacattgttgttacgcaggcagactacatcattaacgattatgcaccacagggacgccaacatttcagtgaagcacaagcgaatgcttgcgagggagaagcacgtttcatgcgggcggcggcttattactatttggcttcttactggcacgatgtgcccattatggagaatccaattgctcatacggaagctttcaatatggctcccacacgcttcgaggatgtgattcgctacggtatccgcgacttggagtacgctgcggagtggttgccgcttgccgacgcggacggtcgtgtgactcgctattcggctttgggactactggcacgctattatgtaacgctggcagcgtatgcgcgtggcggacactgtacacaggctactatggattattatgaagccagcggttctcacgacttggctgacattctttatgatttggccaaggaggctgccggagaagtgattcttgctcagaacagatatggattgatggaagaatatgaagaaattttccgggtacagaacaataattgcaaagaggtattgtttgctttgcaaccgctgcaaggtgtcgactcctacggaatgggtaacagcaacggaagcggtttgtgctcttacacagaattgctgaacggtttgagtgcctataactcctcttatgtatcttacgactgcctgcgtatgctgattaattccggcggacgttcccgtctgcgtggtaatgtgctttgtccgggagagttctatgactatatcggtacacatttggtggatggtggttgggctgccggatataaaggcggacagaaagctgccggattagaaacgaacagaaaagttgccttcaagaaacaggtagtgggtagtgctgaagacacgaataatatcgctattgccgggaactccggtttctgcacaccgatgttgcgccttgcagaagtgtacttgttgtatgtggaggcttgcatgggcaccagtgatgagctgaccgaccgggatgccttgaaatattatgacgatgtccggaaacgcggctacaagatggagatagagagtggcgaactgacctactatgacaccaactatctcacccgtaatgatttgttgagagagtttcgtgtagagttctttatggaaggcctttggtggcctacgctggtacgccgttcgctttacgacacaaagtgggtgaccgattttatcaataacgagttggttattatgaccgaaggtgatgaaggagaacaggtacgcagtgacgaatgggacagcaacagatggtatgcttactattatacgataaacaagaacactcttcaggcggcattcagttctgacagtccccgccagtccgacggagccaaactggcggtacgagctactcatactccgttggcggaaggagattacgtacattcgaatacctctgatgataatgtatgggcattttcttatccggaagtggaaagtacccgtgacccgttattaaatacagcacctgttgcttatgattttaacaaataagatgactactatgaagataacagataagatattaacgaatttgtgtttgagcactttattgctgttctcgttgtttagcgtattttcttgttctgacgacgacgatgatgtccgcatatacagtgtgtggagcaatatgcttgctgaagaagccagacagataacctctgtttataccggaacctggattcgggtggacggtagtggctttagtggtttgcaagctatttattgcaacggtttgcaggtgacggaatacaactctacttacatgagtgactcccatctcacgtttaaagtaccctccagtgttccgatggcacatgagatagaagatgaatcagtgaaaaatacccttagggtggtgacttcccacggtgaaggagtataccgtttcatctttaaagatgtgaacaagatgcccggcattacagacgtgtcatacacgttgccccatccgggcgatcacatcacccttatagggaagtacctcaatggtgcatcagccgtttactttccaggcaatgacggcaatgaagtgcaggttccctatatcgatggcaccggagatatggtagtgtccgaagatggaacgcggataactgtcaaggtgcctgatggagtgggcgaacggagtggttccctccgggtggagatggcagaattgggtgagaactattacactcccaattatatgttttacgacaaagcaatgtttgtgcacgatcatgaaggaaccacagctttgaactatggtgtgtccggaagtgtcatctctccacagaaatgcgcctattactcaatcaacgcggcagatgcgccgcaagtacccgcaggtgccagagcctatatcttcagtatacccgaaactgctccggccactcttccggtggtgagcgataataattcgcctttcggttatttccgtttcaataccggaatgcaattacagtatctgatagacaacagtgacggagaatgggccagagaaacggatgctcgcaaggcggctttgcaggcggacatctatatgaatcatgattggagcaccggcgtggtaggctggcgcatgaacaagaatggaggaaagggtaatggtgaaagtgcgtggaatgtggcttcgtggactaacaataagccatacgcatttaacggcagctggaagacgcttactttcgagatacataccaagtatgccaacttgggcgaggcgattgatgcttggagtgcgagcggtgtgcactcactgttcactatcctcaacttcgatgtcctgtcggccggattgacaatgaaagagggagcggatttccgtatgttcatcactaacttgcgtttggttccctatgtgactccggaagaataaaatataaacatgaaacagattagatatgaaaacttttaaatctatacaatcgggaataattgcttgcctgataataacctttgtaatgggattattttcttgcagcgatgacaatgaaacggtagataatttgctgcctcctaccattgtaaaagtatgtgtttgggatgaagacattgaagaatggattattcctggagcagaaagtaaaattcggattggtacccctttgcgtattgagggtactaacatggcgcagacgattgccgtctatatcaatggtgggctcatttctgcttttcatgcagaagacaatgcgatagagcttgttattccggacattcctgtagatgagggagagattaaagagatgaacctcaacttgatccgggtagtgaataaggcgggagccgctacttgtacggccgaagattttcaattctttggcaggcaaattactgtgaccggtttttcgctgactgaaaatgaaggaagaacgtgggaagccgtgcaagaactgccgataggtggtaagatacgtattgagggtaacggactgaaaacagccaatgaactgtatattaatggtacttctgttgatttgaccggtattcctgccgaagaaaagaacgatgccttcctgattgtgactattccggaaactttgcctttcgggaatgctgtcgagaatccggacagccggaataaaatgcgccttgtgacggcttatgatgatcgcacgctggattgtgttattgcgggcaagcaggtagaaatcaaccgaattacagatgcaaatggtaatgccattacggaagccgggcgcaactcggtggtggtcattgaaggaaaatactttgccacttttcaaaaactgtcttttaacaaccaggaaatagagccgacaacgatagaaagcaatcgtatcactttcactgtaccggtagatacggaagattttacagtgggcgacggagaactgactgttgtcaatgcgtatgatgaaattggtgttagccgggaatttactcttttaggttttgtccctagtgtgacggaaatttcatatacgatgcctaaacccggtaatgtgatccggcttacaggtgtcaatctgtacgataaggcgaaagtctttttcccttcttccacaggtgaaaaggaaggcttcgttcagagtgcctcatcggatgcgacttccatggatgtacttgtgccggaaggtgtgggagataaggcaggatatattcgtatagagagcgaaggtgctgatgttgaagtgaaaggaattgtcatgttctacaaacagggagtgttcttgcaggagttcacggatgaagagttgaaactgggagtttcgtcggggaatttgacgcagaataaatcagcactgtataatccggaaaaccgtccggcaaatgatatgaatccggtgaatcccgattactttatttacttcaaaaatgcttctattccggtaagtacaagtaccggtaaccatggggcttatttgaggttttcgacatatgagcatatcaaaaaaatattggcaacgaataccgaaatttcaaattcaactttaattaagaatgttgcaatgcaagtagatgtttatatgccaaatccttggaatagtggaatgttagcatggcgtatggataaagatggtggaactctgaattctaatcgtatcatgaatattgctccatggacagtcggtaatccctttgattttgacggagaatggcatacatttacttataaactcacagactttgttttgagtacagaagtgaaagaaacctatactttagaaacttggttggcagagtatgctatgaaacgaaactctacaaccggaatttggagtccgtgtatttccctgtttacttttgccaatggtaattttatgcgcaataatgggaataacacaccggatcctcagtgggcttgcgtaaatatcgttaattttgaaatggggcttgccaacatgcgtttggttccacttacacctgtggcttttgaataatcatttaattgtgagataataatgagaaatcttttattagttttttgtctgttcgccgcaatagcggcgaacgcaaaagaagagcctattcaacttttccctcggacgtatgggtatttctccagaggagacagcgaaacacagacgattacttatgaccatgcttacggacagtacggctggaaaaacacaaaaaatgtggatctttccgtttataatcatattgttttagagatagaggctacagactctcgtgtggaaatctatgtactttatgaagggcttgaaaagagcacttgtataggggggatagatgccggaaaaacgaaagccgtttgtgaacttgaacatatagataaggtgcaggcgatttacatagctaaatcaaaggtaggtataaccaagattgtcaagtttgtgctgacagatgaaatagattaagtatttatttgttgaaaaaacagccctcgctacggagttattctccgcgcgagggctgttttgtgtataatctatcttgtgttcaggtaatacatcgcgattggtgttctttttattatcagctttgttttcttgtcaagtagcttgtttgcaagctgattaagtagggaggtataagaagagaagcaggtatagttgcgttgggataccggtattgttccattaaagtaccgcagggaaaacgcattataaatcatgtaaaataagttcccataagaattcattatcgattatctcacctaatgctacactaaaatagatacagtataggaatgatagatgttttttccactatgtatgaccgaatccatacagtttcactcattttcgcactgtttcattcatttccgtgcaaaaacgagctaaatgttttaatatctaatggttaagcggaagtattatcacgctttgttaacagtattattatcttcttcaattttagggtaattaactgaaaatataaacaataattcctgtaatcgccacatatattaaagcataaggaatagctgctttcagtatttcaccttcttttccctgttggtttccggcagaagtagcaatggcaatactttgtggagagataatcttaccccctgtagcacctactgtatttgcagcagacagccaatccggactgacatgaatttgcccagccacacttgcttgcaactttccgaaaaggatgttggaagatgtatcgcttccggtgataaacgttcccaaacaaccgataaccggagcaaataacgggtataaacttccggtagccgtagccagtgctgtggcaatcacggcgatcattccggaactatccataatagtagataaccccacgaggcagataaccgtaatgaatgttttcttcaactgcttcacggtattccaaagaacgatgaacagatcttttactttagccccctgaatcaatccaccgataaaagtaccgatgaaaagcaatactccggcatgggtcagccaggaaatagtataattaacggtggacgcattgataggaaggctgattctcgtaatccagttattctctaatgtatgacgtaatcccggaaagaggggactggttaagataatcagaaacagaatcagtaaataaatgctccatgcatttaatatatctttcgttttcagatggctttttcgtgctttctcttctttggatgcagtaagttttccataaataacgattacgataatagaaagaatactgccgattatggccggagattcagcacccatatattttgctgccacatattggctggctaaagagactccgcctaccaataaagccaggaatatatttttcgggagcgacttaagtttggaatcagtaaggaaaagtagaaccagcggaatcaggaacattaaaacggataattgcaatacgacattcgtactaagatgcaatacgtccaaattcgtttctttggccaatactaataccggagttccgattgctccgaaagcagtggctacactattggcaatcagactcaccgttgccgaaaagataggcttgaatcctagactgataagaattgccgccggaatagctactgctgttccgaagccggccatagcttccaatagacctccaaatccccaagtcagtaataacacctgaatacttttatcggtagaaatagatgcgaattgctgtttgataatctccatcttttcagttttcaacaatacattataactgaaaatagccatcaaaataatgattaagataggagagacagcttttaatgctccatataaaaaggagtaaaacagattgtctaccgagaaagcgaagccgaaaagagcaatcagcatcgtcacaatcagagaaatgatactacttttatcacctgacattttaaaaaatgccatcagtataatcaacagtaacactggaataacagcaaggatcaaggtcataattatcagatttaaaaagtggaacgtcgtttattattgatataacaaacgaacgccccactttggtcggttgaataaatagatttttctgtttatttcatcttcacacttaaaatttgttgtaattgttttaagttggcaagggcagcttcgttacctagctttgctgcctgctcgaatgcggccatggcacggttaatgtctccgttaaggaaattgtagactccggtattgttgatgaactcggcagtattgtgatcggctttctccataaacttcactgctgcatccaaatccttttgtgataatgcgacggctcctgcgttcaggttagctacggcgtcagtaggatacatgcgtacagcaatatcgaatacattaacaaaatccttgctgcctttcggataactgttggccacctgatacatttcgttcagactaagatatttcggattttcccggataatgatacggccttgttcaacatcgaaattgacaacggtatagtcaatcttgcagttcactttacgcaatcccggataaatctctttcagcatactacggtaaggagctccgccgcctacacgcatgatttcctgtttacgtttggcatcgtcagttgtatttttgatgatgttcaggaatgtttccttctccttcatcgaagaagattggagtgcttttaccaatccatcccagttttctccaccgaaagtcactttatatagtttggaaggcactttttcgttcttaaccagataatccttcaaagcttccgcacgttttttggaaagctgttcattgaaggtaagaggtccttccggcgaggcgaaacctttgatactgatacctttcacagtcaggttccggtcattctgtattttgtcaaacatggcatggatattcaccaattcagcatgattgttcatgaagtcggtaaggatcaccgatttgttgaccggaaaatccagatgagcttcatattgttcgctacggtttttgaccacttctacggttggctgaatataggcaatgataggagacatggcacttaaacgtttggcttcggtagatacatcattggtaatcagttcctgtgcattcatttcctgataattgccgcatccgcatagattctctacaagttgcaaactggcattagccatccagggtttgtaaggaatcacctgcgtataattaaaagtttcccttttattataaggaacgataatggcggtaggttcttgcttagtgattgccagactgcggatatatgctttttcgcgtcttttaccattgacgatgatttcttgcaagggtacattatgctgtccgtccgtcagcaggggaataaggcttaaacttcgggcggaacctattgtcagattcttcatgtcgaaggtcatgctgacatagagagagttaccttgttgccataaagatacgttcgagagagtgagcgcatcgttcaggaatttttgtgcatgagccggtaggatggcggctgcaaaagctataaatagataaataagttttcttttcatcattgtaagttttagagagttcgattatttgatgacataaatgaaactaagaccgattttggtcggaccgaaataattgcgggtgttatgtcccaacttttcacctccgtcaccacgagcatacttgtcatattccagacgggcgtatcccactccgatggtagcttccatactccatcgtttgcttatgatccattgatatccgtaggaaataccggctccgtacagattgccgtcgtaacggtcatgtcccattccgaatatattcagattgctgacattcatttctccgtaatgtccgtgcaaaccgaagaaacttccgttgaaacgttcgcagagccaatagcgtaattccggctgaacgagccaatgtttgatttgacggtcgtcaccaaacttccacggattgtagttaccggatatgtcgagagtcagtttctttgccaatcccacttcgattcctaaattgggcgtagaagtggcccaatagagagcattggtcttgatggcaaatttgggtagataggtttcattccgttgtacctgtgcatgaatacttgtaccgaacacgagcaggaaaccggctgctaataagattttaattgttctcattttgttagggtataggttttattaaaaatgataagcgataaacagaaaagcggggaagtttgttgtcgcaacctgcaaaaaaagctccctaaataaatggataaagatgttttaaggcataaatgctaacaatttccacgcatgatgcgttcattatataaaagtacctttgtgtaatcaatatgacaatgatttcatttattactgtttatttttacacacacacatacaactttaataattacagcctatgaaagagcttattagcaacctggaagtactgaacaggaaagcagaaaaaggcggcggagacgctcgcattgaaaaacaacattctgtgggcaagctgaccgcccgtgaacgcatcgatttattattggagaaaggttcgtttatcgaactggataagttggtaacccatcggtgtaccgatttcggtatggaaaagcagaaattcgccggagacggggtggtgacgggatatggtatgattggcaagcgcctggtttatgtattcgcacaggatttcaccgtatttggaggagctctttcggaaacgcacgctaagaaaatttgtaaagtgatggacatggccatgcagatgggagcacccatcatcggattgaatgactcgggaggtgcacgaattcaggaaggagtacgttctttggccggatatgccgagatattcctgcgcaattctatggcatccggagtgattccgcagattagcgcaatcatgggaccttgtgccggtggtgctgtttattctcctgcattgaccgattttattttgatggtgaaaaactccggttatatgtttattacaggaccggatgtggtgagaagcgtgacacaggaagaagtgacaaaagaagaactcggtggagtaggcgtgcacatgacaaagtccggtgtagcccatctttctgcggaaaacgatattgagtgcatcaattatattcgtgaattgatctcctatctgccggggaataatatggaagagcctccgtttgtagcgaccagcgattcgccgactcgcctgactccggaactggcagatttgattccgtccaatccgaatcagccgtataatataaaagagatgatagaagcggtggctgatgataatagtttcttcgagcttcaggcagaatatgctgcgaatattgtgacgggatatatccgcctgaatggaaaaacggtgggagtggtggctaatcagccattggtgcttgctggtacactggatatcaatgcgtctatcaaagccgcccgttttgtccgcttctgtgatgctttcaatatccctttactgacactggtagatgttccgggattccttccgggaatcgatcaggaatatggcggaattatccgtaacggggcaaaattactttatgcttattgtgaggctacggtgccgaaagtgacggttattacccgcaaagcatacggtggtgcttacgatgtgatgagttccaagcatatccgtggagatgtaaatcttgctttccctaccgccgaaatcgcggtgatgggaccggatggagctgtgaatatccttttccgtaaggaaatagataaagccgagaaacccgaagagaaacggaaagaacttcaggatgattatcgcggaaagtttgccaatccttaccgggcggcggaactgggatatgtggatgaagtaatcgatccggcagtaacccgtttgcggttgattcgaagtttcgagatgcttgccaacaaacggcagtcgaatcctcctaagaaacattctaatctaccgctgtaagcctgtttatggattaaatccgtgcctaaaattattaaattgctcttttaagttttgacttctaaaaagaaaaagattatgataaaaaaaatattagtagccaaccggggtgagatagcgatgcgcatctttcggacttgtcgggtgatgaatatctcgacagtggctgtttatacccatgtagaccgcggagctttgcacgtgcgttatgcggaagaagcctattgcatctccgaatcgcccgaagatacctcctacctaaagccggaattgatattgtccattgccaaaaagaccggagccgctattcatccgggatatggtttcctgtcggagaatgcggattttgcccgccgttgcgaagaagagggagtgatttttatcggaccgagtgcggatattatttccaaaatgggaatcaagacggaggcccgtaagattatgcgggaagcaggattgcctattgtgcccggaaccgaaacaccggtacagggcattgatgaagtgaagaaggtagctaatgaagttggctatcccattatgctgaaagcacttgcgggaggtggaggaaaaggtatgcgtctggtacgtacggaagaagaggtggaaactgctctccgtttgtcgcaatccgaagcagggacatcctttggcaatgatgcggtttatattgaaaaatatattgagaatccgcatcatatcgaagttcagatcatgggagataagtatggaaatgtcgttcatctgtatgaacgtgaatgttccattcagcgtcgtaaccaaaaggtgatagaagaaagtccttctccttttgtgaaagaggagacgagaaagaagatgttgaaggtagccgtggaagcctgtaaaaaaataggttattacagtgccgggacattggagtttatgatggataaggaccagaacttctattttctcgagatgaatacccgtttgcaggtagagcatcctgtgacggaggagtgcacaggcgttgacttggtacgggatatgataactgttgctgccggaaatccattaccttacaaacaggatgatattgagtttagcggagcagcgatcgaatgtcgtatttacgccgaagatccggagaataacttcatgccctctcccggtgtgattactgtccgtgaagctcccgagggacgtaacctgcgtcttgacagtgccgcttatgccggatttgaagtctctctgcattatgacccgatgattgccaagctatgttgttgggggcgtacccgtgcatcggccatttccaatatggcacgtgctttgcgcgagtataagattctgggaattaagacaacgattcctttccatcaacgtgtattgaagaacgcagctttcctgaaaggtgaatatgacacgacgtttattgatacacgcttcgataaggaagacctgaaacgtcgtcagaatacagatccgacagtggctgtcattgctgccgcagtgcgacattacgagcgtgagaaagaagcggcttcccgtgcaacaacactcccggtagtaggagaatcactctggaagtattatggtaaattgcagatgactgctaataattattgatttgagactaataaataacggaacagattatgggtacaacattagctacatattacgccaagctccaggatatgccggacagtgaatataaggtggagattctggaggacggaccaatcaagaagattgcagtcaatggtaagatatatgaggtcgattataacatgggtggcgactctatccattcgatcatcatcgatcaccactcgcatggagtgcagatttctccttcttccaataattcatatacgattatgaataaaggggagctttatcagattgaattgcagggagaaatggagaagatacataatgcccgcactgctgctgaatccgtagggcgtcaggtggtacaggcaccgatgccgggagttatcctgaagacgtatgtaaagaaaggagatctcgtgaagcggggtgatccgctttgtgtattggtggcgatgaaaatggagaatgagatacgttcggtgacggatggagttgtgaaagaagtattcgtggaagatggcatgaaggtgggattgaacgaccggattatggtaattgagtaattctttgaaaaaaacggggtaaatacgtgcttttattcaaaaaaatatttacttttggcagataagtacgtatttacaccgttacattatgagtatcgaacaaagcaaagaagcattattagaacagttagaagcacttaaaaaagaaaacgagcagcttagaaaagaactttctacccttagggatgagaaatataacgatcgtcctgttagttttaaagaaaaatatgctgttagaatactagactctcttcccgatatgctgactgtcttcaatcagagtgaggtaggtattgaagttgtttccaatgaggaaaccaaccatgtaggaatatcaaacaaggattttagagggatgcgtatgcaggatatggttccaccggaagcatatcagaatattcactccaatatgcgtcatgctatcaccaccggaactgtttcaactgcacatcacgaactggattttaatggtgaacgccattattacgagaaccgtatttttccgttggatgaggaatacgtgctgattatgtgtcgtgatataacggaacgagtagctacccaaaggcagttggaagtttttaaaagtgtgctcgataaggtgagtgacagcattcttgctgtggcgggagatggaacgctggtttatgcgaataagcaatttatagaagaatacggtgtaacgcaagagttgggtacacaaaaagtatatgatttgcgtgtctctatgaccgacaggggggcgtgggaaaaaagattgcaggaaattcgtgataacgatggtagctttgcttatcgggcggcttatataccttacgggcatacgaaggagagagtacatcaggtatctgcttttctgattcgtgaaaataatcaggaactcatttggttctttacgcaggatattactgatgttatcaagaaacgggatgaactccgcgaactgaatttattgttggatggtattttaaataatattccggtctatttgtgtgtgaaggacccggaagatgattttagatatttgtattggaataaggcatttgccgatcattcaggtattccggcgtctaaagctatcgggcatacggattatgaaatatttccggtgcatggagatgcggagaaattccgtaaagatgatttagaattacttcagactcataagcgcattgatatgcaggaaacttatttgtccgctaatggagaagcgcgtatcgtgcagactttgaaagcacttgtaccgatggagggacgtaaaccgttgctgattggcatttcatgggatattactaatcttcagaatattgagcaggaactgattagggcaaggattaaagcggagcaatccgacagattgaaaagcgctttccttgctaacatgagccatgagatccggactccgctgaatgctattgtaggattctcccagttattgccttctgccgaaactgctgaagagaaaaaactctattcggatataatcaatcagaattcggatattttgttgcaattgattaatgatattctggatttatcgaagatagaagccgggacactggaatatatcaaacgtccaatgaatctgggagaggtctgccgaacaatttatactgttcataaagaacgtgtgaaagaaggggtaactcttgtctttgataatgaggaggaggatttgctcatggagggagatcagaaccgtatcatgcaggtgataacgaatttcctgactaatgcaagtaagtttacctatgaaggagagatccgttttggttttggacgaatggataaagatattcgtgtgtatgtaaaggatacaggaatagggatagaaccggaaaaggtagatcatatcttcgagcgttttgtcaaactgaactcttttgcccaagggacaggattaggtctgtctatctgtcggatgattatcgaaaaaatcggtggagaaataggggtgacttccgaactgggtaaaggctccacattctatttcacgatcccttatgaagaaaccggagagcatggtaaattctttaaagagtcgaaagtggtatctaaaggaaatacagtcaatcgtgtacaacagattaagaagattctggtagcagaagatgtggagagcaattttatcttgctgaagaatctgattggcagggaatatacattgctttgggctaaagacggagtggaagctatcgaaatgtataagcagtaccaaccggacttaatcctgatggatgtaaaaatgccgcgtatggatggactggaagcaacccatattatccgctcttattctaaagaaattccaatcattgctttgacggcttatgcttttgaggcggataaagaattggcattggagatgggttgtaatgactttgtgaccaaaccgatttcggaaagaacattgagaaaggctttagataaatattcgactactgtttaaaaaaaggattatggctatatgtatccggtgaaagttacttatgatagccataatccacaaaagagtacgattgttgttgagtgaaagtagtcggtgattacttttctatagattcttttttatttccggaaccagtataaacttcgtttccggaaaatactttttcagccaggtccggataaattccattgtatcattctgaatcgtcttgtcttctacggtaggatataaattatataatacggtatctagtacaatgccgcgtttttgtattgcttcgagactaagcagggtatgattgatactccccagtttgcccgaagtaacaaagataagcggatatttttcttggacgatgtagtcaatggttaaaagttcagttgtcaggggaaccataaggccgcctgctccttcaagtaaaacagagtcataccgttcactcaattcttcggtcgcacgttttattttatcaaagtcgatggggcggttatccagctgggaagcaagatgcggagaggcgggataagagaaaatctccggcatggttagtccctcttggtcttctttggtgaaagggattcccatgatttgccgatgtaggtcaatatcttcggaatgacctacatttcccgtttgaataaatttctgggtgatggtgcgatgcccgttcttgttccattcacgagctagaaagccggtggcatagctttttccggcatcagtgtcgataccgcttacgaaatatacattctgtttcatacttttttcttttttgcgatgatataaatagggtgatatgttaaggacacagaagtgccctgagtaaattcctgcgtgtaacgttcacagaagagttgcaagtcacgacgagtccactgttgttgggggagattgttcttagaattgttcttagaattagttcttgaattattctttgaattgttgtctgatgaacacaaatcgttctcttgttttccggtaggagaggattgcgttgataagccattgactccggtttgcttcaagtgatatagtacttttatcgggtcttcgaacgaaagcgggataagctcttcttctgaatacagtatgtcaaaatggggtgacaaagctacttcgagctcttcccgtgaacgataaggaagtccgttgccggtaagttcgcgtatttctttcatgttttcttttccaaaagtgctaaaagcaaaataaccctgattattgagtagggtattacacctttcgaaaaagttttccggtgattcgaaccattgcaaggcggagcaggaagttatcaatgtactttcggtggggaaagagactgtttcggcatctcccggaagaaaagaaacctgcttcttcattaataagtcctcacagcaatatttcatatcggggcaaaggtcattaagtaataactcttccggacggagggcttggagcagcatacgggagtaaataccggttccgcagccaaattcaattactttcgaacagggagaaggtatgtgttctgtaagcaaacgaatcattttacctgctatttgccgttgcacgtttgcttcctttggataggtagtgatagcttttgaaaaacgttctgcgattagtcgtttattcataatcgatatttatttaataggctgatatacttgataatcactttattttaaaatgatggatgcatcagttctccggctgcatgagtatcgtgttaaaaagctcttgttggtaatgtgccgcttccacttgttcaagagagtccacttggttttcccatgccaaatattggttatccgggaggaaaatgcggtcgccttttcctatgatagctttttgccatttaaaatcagagggcggcaatgataaatattgttgttgtatagcggcaagttcttctttgagttcttccatcggacgctggggggatatggtttgaaaagttttatagtcagctattgaaccacacattcttctttgaaatttttgcaaggtttgttcattcagcccttgaagtgtgccatcgaaaatagagtgagcgatacctttggtttcgtgtatggggtagagggtgccgttgatggcgatactttgggagacaggcagatgtgggtactgcttcatgatttgcgaagctgcccagactcccatcgaccaggcgataagtgtaatctgggaataggtttctaataagtcggtatcaaatgctaatgaacggtaatcatagcaaatcatccagtccttatctgtaggatgaatggtcaggaaaggagtttcgtccatcccccaaccggcgaagaaaagcaatagatgcttctgattattctttatgataaaatgctgcttcattcgtttatcaatttgatgagttggtcaatttcatgttcagtgatgtccgctgtcagtgaaaaacggatacgtgaagttccgtcgggtacggtaggcggacggacgggcaatgcatagaatcctttgcgctggagttcttctgctttcaatatggtatcttcactggctcctataatcataggtacaatatggctcaccgatgggcaattatatcctttggctgtaagggctacctttagcttttcactgatttgtagcaggtgagccctcttatgttgtaaagctgaaaggcgttctaacatccacgaagtccactggatattgataggaggaagtgcggtggtgaatataaacgtgcgcattttattaataagatattcccgaatgagttgccgacagacaatataggcacctgccgaagcaatggcttttccgaatgttcctactaaaaagtctatatcgttgatacagtcctgttcttcggcacatcctaatcctttttttcctcgtacaccaaaagcatgagcctcatctacataaagaagaacattggaataactctttttgagttgaatgagagcgggaagatcagcttcatcgccatccatgctgaagatactttcggtaacaataataagctgctcataagcgttatgattttcagcaatcagtcgttgcaactgggaaatatcattgtgacgataccgaatacatttagctgatgataatttaattccgtctatcaggcttgcatgcactagcttgtcggcaagaatcagtgtgtgagtattgcaaatggcaggaagtattcctgtattggcatgataaccactattgaatataagtgcactttccgttccgaacatcgtggctagctgttgctccaacttctgatagtcactaaaattgccggtcagtaaccgggaagaggaggaagtaggcaggaatgtttcaggggtgagtgtttttaagaattccttcctcaatgaaatgtcattggacagcccgagataatcattagaagataggttcaacattcgttgtccgttcagcagaacatctcgtccttcgtgaataagcggtgggagagaacggtagttctttttctctttcaaggtctggagttcctggtttatatgttctaatgtcatgaattattgttttaagtaataagtattcgatatatggatggttgaaagcgtaatcagttgtctataagatgtttattgtctaaagaagtatcccgaaagtttctcaccgaccaaggcatccttcctcggtgaggaaaggcccgttcctcaccgaggaacacccttttgctcaccgaggaacagattcttgggtgaaaatctggtaatattcttcttatctgtcatcttttttgaataactttaagtaagccggaagtcagttcgcttaattgttccgaagtgatgatgaaaggcggcatcagatataccagcttgccaaagggacgtacccagattctttcttccacaaatcttcgttgcatataggccatatttaccggacgtttcatctcaatgactccgatggctccgagtattcgtacatcagccacttccggaaattcccgtgcaggagccagttcttctttcagttgagtttcgattcgcttcacattctcttgccaaccggattcgagcagcaggcgaacggaagcgcaagccactgcacacgcaagtggattccccataaatgtaggtccgtgcataaaagctcccggtgcgtggttagagattgtatctgctatccggttgctggtcaatacagcagaaagtgtcatatatcctccggtcagtgctttaccgatacacattatatccggttctactccggcatgttcccaagcaaaaagtttaccggttcgtccgaatcccgttgctatctcatcgaaaataagaagaatatcgtgcttccggcaaagcttttctgcttcacgtaggtactgcggatgataaaaccacatcccgcctgctccctgtaccaccggttctagaataagcgccgccaactcttttgaatgtttttcaatcatctcttgtagaggtagtatatctttcggattccattctccgtcgaaccgggaagtgggggacgggacaaaataacgtacaggcaatgccgagccgaaaagactgtgcatacccgtcaccggatcacatacagacatggcattccacgtatcaccgtgatagccggaacggatagtcacgaaattgttcttttccggttttcctgctgcataccaatattgtacagccattttcagtgccacttctacggctaccgaaccggagtcagcatagaatattttctgcatggaggaaggaaccaaaggcaataacaatttccccagttcaatggccggatcatgcgtcagtcctccgaacatgacatgagacattttatctaattgttcttttgccgcctgatttaataccggatgattatatccatgcactgcacaccaccaggaagacattccgtcaatgagcgttcgtccgtcttcgagggtaatggtagcgccgtctgcccgttttactttgtagacaggaagcggatcggtagtcgaagtatacggatgccagatgtgctcgcgatcaaattgggaatcggcgaaatgatagccttcttcctgaatcatctttttgtcttccgatactttggagccgagtgttgtcaataggtcgcctacgatagccgagttaattccgatatataatgccttgtgcatcgcttcggaagaaagttgtgaacgtcctccggcaaaacgcagaaaagcggtcggattgataaaacgaaagagtgcgatggttttaagtatttcttcttcgcttagaggctgctcgttttccagtggagttcccggaatcggactaagcaggttgataggtatggattgaacattcagttctgccaatgtgaaagcaaattcaatccgttgttccatcgtttctcccatgccgatgatacctccgcaacagatatccatgcctacacgacgggctgcatcgagagtagccagtttctgttcttgcgtatgcgtagagcagagtttggaaaaataagacggggcagtttccagattacagtgataacgggtgattcccgcttcatgcagggaacgcaattcttcttcattgagcagtcccagagaagcacaaagttgaatcgacgaatgtcgacgcatatagtggactgtatcgcaaagttgggtaatctgtttgggagatggttttcgtccgctggtaacgagggagaatcggttgacgtcctgggcttcgttgtattgggcctgtcgaagacattcttcagcgggaaggagatcgtaaatctcggctttagtctggtagtgggaggattgtgcacaccatttgcagttttccggacatcggccggacttggcgttgatgatggaacacatgtcgaactcgtgcgaagcacgcgcgacggtaatctcatgcgcggcggcataaagcgcctcgctgtcagccatgttggctagccaagcagcttggtcgggtgatatgtcgatacccgccaacacttggtctttgatttcctgaagtgtcataaatgtatgataagggatagtttgtgcagcattctgcttacgaagagcaacgtctactacattgatatgcagatgaccgatttggaattcacgtcccatacttgcaaaggcagcatagttctttcttccccagtagcgaaagcgggaaaggagcgtgcgtgtggtctgtatgtggcgttgttgcttcattgatttttttacttttgttcgttagaacgtggcaaatgtacaaagattctttggataagcaagttgatgatttctagtttctgtggtattatttctttttcctgtattctttgcgggtgttgaagttgaatccggcatatatttggagagtaccgaatccattgtctacagagaaattgttgcgatgataattgtagtttttcccaacaaaagaagtacctacataatactttccggtgttgtagacaatccctgcacgaaccagaaaatccagattgaatttaccgtaccatgcttttgcttcatttgtttctgcgtccacatcggaagctttgtaggcaatggcaggggtgagagacaggcatgccagacagttgcgggcaaagacccaattgtaggcgtagccgaaactgatattggcattggtgtatttaatattcttgactttcatggcaggattcatcgcctcctggataaaccccggaagtgctgtatagtcgaagtcgagatgatgctttgaaatggaaaaacctgcaataaatgtacctgcattgcgtcgttgattagtggactgactgaatgcggcaggataggagaatttacggttattgaagatataatatagattcagtcctttgatatctacctttattccgctgaaatcttcggaatagttagaggggatatcgtctgaaaatcctctgattttatgtattttgtaatcattaccagtgcggcgatagaagatatccacacccagtttggaactgtataggctaagatcgaattctgttcctctgttctttcgggtaccttttttgaaaatatcgttcacatctacagaccatcccaggaaaatccatcgccagccgaaatacaatcctatcttgttgtgcgggttgggagaaaaactaagtttctgtggctgcggcaattcactggtgatagaataatactcaaagttgctgaaatgagtaaccatcagcgcatagttataacggttgggactgatatagagcgtatcgaaatcactgaagttcataaacttcttgatcgctcttttaaaagcacttggcttggtggttgttgtggaatctacttctgtactatcgttgcctaaagagactttctcttcagtctgcgcctgtaaggacagtgaaaataacagaaaaagatatagaataacccgtttccccatgtggttctttgttggtatagatatttttagtttcacgaatgtactatctttcgttgatttatactagcaatcttctaaaaaatgtttcgtttcctaaacaaaaaagttcaatgtactgttagttacaacaagcaaataaatcttaagccacaaaattatgagaatctatttacgtttattagtcgtgtctcttctgctttttgcaggaaatatagtatatgcggaagcacagcaggagaaacgcgtgacaggcacagtgacttctgaaggagaacctttgcctggtgtctccgtacaattgaaaggagcatcttccggcaccattaccgatattgatggaaagtattcgattgagattcctgcgaccggcactttagtgttccgttttgtaggaatgagaacggtggaacaaccggtgaataaccggagtgtgattaatgtcacgttggaatcggaaagtaaggaactggaagaagtaatggtggtagcttatgctaccgctaaaaagtatagttttaccggagcagcttcgacgatgaaagcaggtgagattgaaaagttacagacttccagcatatcacgtgtattagagggcacggtatccggagtacaggcaagtgcggcaagtgggcagccaggtacggatgcggaaatccgtattcgtggtatcggatctatcaacgcttccagcgccccgctttatgtagtggacggtgtcccgttcgatggtagtgtgaactctatcaatccggatgacatatcttcgatgacagtattgaaagatgcggcctctgctgctttgtacggttcccgtggtgcgaatggagtgattattatcaccaccaagcagggagatcaaaataccaaagcaacggtaaaggtgaaagcttccttaggaggttccaaccgtgccgtgcgtgattatgatcgtgtcagtaccgaccaatattttgaattgtattgggaagcacttcgcaatcagtacgccaagagcgcggattatactccggcaactgctgcggcacaagcatccaaagacctggttacgaaattgatgggaggtggaccgaatccatacggtccccaatatgcgcaaccggtcggtacagatggaaaattggtggcaggtgcccgtccattatggaattcagactggagtgacgccatggaacaacaagcacttcgcacagagttgaatctaagtgtttccggaggcggaaaagcaaatcagtatttcttttcagccggatacctgaatgataaaggtattgcgcttgaatccggttatcagcgtttcaatcttcgttccaatatcaccagcgaaatgacctcctggttgaagggaggagtcaatttgagttttgcacattctatgcagaactatccggtttcttccgactctaaaaccagtaacgtgattaccgcagggcgtaccatgccgggattttatccgatttatgaaatgaataccgacggtagttacaaattggatgagaatggagaccgcatttatgacttcggctcttatcgtccttccggttcgatggcaaactggaatctgccggctactttgcctttagacaaatcagaacgaatgaaagatgaagtttccggtcgtacttttctggaagctacgattattgagggattgaaattcaagactagttttaactttgacttgattaattataatacgttggattatacgaacccccaattgggcccggctaaagaaaacggcggcggcgtcagccgaatgaatacccgtactttctcttggacatggaataatattgctacgtatgacaagacaatcggtgaacatcattttaatgtccttgccggtgtggaagcctattcttaccgttatgatgaactgacagcatcacgttccaaaatggcacagcctgatatgccggaactggtagtcggttcgcagttgaccggaggttcggggtatcgcatcgattatgcgttggtgggttatctgactcaagcattatacgactatcaaaataaatatttcttctcggcatcctatcgtcgcgacggttcttcacgttttgcgccggagacccgctggggaaatttctggtcgttgggtacttcttggcgtatcgaccgggaagagtttatggcaagtacttccgactggttgtctgccttgactctgaaaatgagctatggtgcgcagggaaatgacaacctaggtacttattatgcaagtaaaggactttatactattgtttccaatttgggagaaaatgcgttagtgtccgaccgtatggcaactccgaatctgaaatgggaaacaaacctcaactttaatgtaggtatcgacttctccctgttcaataaccgtttttccggttcgtttgatttctttacacgtcgttcgaaagacctgctttattcacgtccgatagctccttccctgggatacggttctattgacgaaaatgtaggagccttgaagaatacaggtatagaaatggtacttaacggaacgattatcaatcagaatggttgggtatggaaactgggtatgaacttgacgcattataagaataaggtgacagacctcccattgaaagatatgccgcgaagtggtgtgaacaagttgcaggtaggtcgttcggtgtatgatttctatatgatagagtgggcggggatagatcctgaaaacggagatccgctgtggtataaggatgaggtggatgcaaataagaatccgaccggaaaacgtgtcacaacaaatgattatggttcggctgactattattatgttgacaaatcgtctcttccgaaggtgtatggcggattcaatacgtctctttcttggaaaggattcgatctttcggctatctttgcttacagtatcggcggatatatctacaatcgtgatgttacaatgattctgcacaatggaagtttggaaggtcgcgactggtcgacggagattctaagaagatggactcccgacaatcgctataccgatgtccctgctttgagtactacctctaataactggaactcggcttccactcgcttcttgcagaataattcgtatatgcgattgaaaaacctgacactttcctataacttacccaaacaatggattagtaagttgtcattgagcagtgtgcaggtatatgtacaaggagataatctgtttaccattcaccggaatcagggactagaccctgaacagggaattaccggtatcacttattaccgttatccggctatgcgaaccatctccggaggtatcaatgtttctttctaaattcagactaaattatgagaaaaataaaaattcaatccattcttgcggcagttgccggacttttcctggcaacgagttgtagcagcagttttttggatacggaccccacagatgcggtaagttcggataaggtatctgtacccgaaaatgcggaggcacttgtgaatggtgcctggtataatctgtttgattattcaagtacctatgccaatatcggttatcgggcacttcagtgtctggatgatatgatggcaagtgatattgtttcccgtccgaaatatggttttaactcttcgtatcagtttaatgatatagcgcaatcctcaaatggtagaacagagtttgcctggtatctgatatataaaacgatagataattgtaacactgccatttctatcaagggggattcggaagaactccgtcaggcacagggacaagcattggcattacgcgccttttgttatttgcacttggtacagcattatcaattcacctacttgaaagataaagatgcttcgtgtgttcctatatataccgaacctagcaatagctccactgtaccgaaaggaaaatcaacagtggcacaggtttatcagcttattttcgacgacctcactttggcgaaggactatttgaaaaactatgtccgcagcggtgataatcaaaagttcaaaccaaatgtagcagtagtcaacggtcttttggctcgtgcttacttgctgacaggacagtgggaagaagctgcgaaagctgctgaagcagcacgtgcaggatatacgttgatgacaactacagccgagtatgaaggttttaataatatttccaataaagaatggatatggggatttcctcaaattccttcccaatcggatgccagctataatttctattatttggatgcaacatacgtaggagcatatagcagctttatggctgatccccatctgaaagatacatttaccgaaggtgatattcgtttacctttgtttcaatggatgcgtgaaggatatttgggatataagaaatttcacatgcgtgcagatgatacggctgatctggtcttgatgcgtgctgctgaaatgtatttgatagaagcggaggcgaaagttcgtgatggtgtagcgttggcacaggctgtagctccattgaatacattgcgtaatgcccgtggagtaggggattatgaggtgacaggaaaatcacaggaagatgtaatcaatgagattctgatggaacgtcgccgtgaactttggggagaaggatttggtattaccgatatacttcgtacacaaaaggcagtagaacgtgctgctttatcggatgagatgcaaaagacagaagtcgattgctggcaggagggtggtagctttgaaaaacgaaatcctctgggacattggttccttaacttcccgaacggtaaaccgtttacagtaaatagcacctattatttatatgctattccacagaaagaaattaacgctaaccctaacatataaatagctctcttaattttttgactttgaccttaacttgtagaccggtatacgtcgtgacgacgcataccggtcgttttctttggaaaagagggagcgcaaaatgtgacacaccctattttatttaatctaatcttattctatttttttcttcttcaaattaggtaaaaagaatgtgaccaatcctagtagcggcatataagcacagatattatatacatattcaatactcgttttatccgctaaattaccgagtacagcagatgctacaccagccaccccgaatgcaaatccaaagaataaccctgatattaatccgagcttggtaggaagcaattcctgtgcataaagcaatatggcgggaaaagcggaagaaagcatcaatcccacacagaagctaaggataatagtccacatcaaattagcatgtggcattagtaaactgaacggggcagctcctaaaatagaagcccaaatcacatacttccgaccgatacggtcaccgacaggtccgccgattaatgttccgatagcagtagctaccagaaagataaataaatatagctgcgaatcttgtacacttacattgaatttatgaatcaaatagaaagtataataactcgtgagacttgccatatagatatatttggagaaaatcagaatcagcaatatcgcgattgaaagggctgtcttatccataggcaaaggaagatgaacaggttttctaacactgacagtctgtgctttcatccggtttagatatgatttataccatttgcaaattgggtacatcactccgatagcagctaaagccacaaatgcaaatacgatgagatgttgtctgccataaggagccaccaatagagcaaccagtaaaggacctaatgaacctccgaagttgccacctacctgaaagagtgattgtgccagtccacgttttccgccggaggcaaggaacgtgatacgggaggcttccggatgcagtacggaagagccaattccgattaagaatacggaggctaatatccagtatagattatcagagaatgctaagtttatcaaaccaatcagtgtaaagctcattccgataggcaatgaccatgcgacgggatgcttatcaaagaaaattccggtaatcggttgaaaaactgaagcggaaagttgataaactagtgtgataagtccgatttgcgcgaaactaagtcctaaatcatctttaaataaaggataagatgctgatagcaccgactgtaaaagatcgttgaggcaatgcgaaagactcaatgcaatcaaaatggaaaatgtaatttttcctacgggttgttcctgattctgtaccataatacctatttactattgaagtgttcctgaaaaatcggctgcaaaggtacggaaacttcccgtttctcaatatatatttgctgtgattaattcaatatgataggaataaagctctaagactaaggattgtaaattgtcgttaattcagttttgagtgactgaactattcttcatacctactgttgttaaataaaaaaggaggattatatgggctttatatggtatatcgttattggtattgtggctggattcctcgcaggtaaaataatgcgcggcggaggttttggtcttgttataaatttattacttggtattcttggaggtgtactgggcggttgggtgtttgcccttttcggactggcagcttcaggactgatcggaagtttgataacttccaccgtaggagctatccttgtattgtggattgcttctttattctcgaaatctaaatagatatttatataatttatttttaatcctaaaaacagaacttgattatggaatgtagacatggaaatttctggattggactcggaattgggtcaatccttggcgcagtagcttatcgtctttcacgtacagcaaaagcaaaacaattagaaagtgaaatttataatgctatccatcgcataggtcgtgatgctgaaatagctgctgctcatgctgaaagaaaagcagtggatcttggacttaaagcagtagaagccggtgcggaaattgctgataaagtagcagatgaagccgataaagtggctggaaaagcaaaagataagtgggggaaataagaactccaaaacgggtaatcgatttaaatagaatcggttacctgttttattttatatacgtttaatcttttatttctagccttatcagtcactatttgaatgatgtgtgcacgaacacatattggtgtgtcttctccattattttcacttccttcaagaatcaaaagctattttccctctgatttctcatctgataaatgcttttttctctatactatctttactttttcttatgtttaacaacatgtatacttcctggttgttctggttaactagctgattattaataatatgttctttattgtatgttatgtgtgtgcgcacacactattgcttaattcaataattcattttacttttgtcgatgaaaaacaagatacttatcaataaatggataaagagttttcaaatattcggattgtagacattgctaagatggcaggtgtctctgttggcacggtagatcgtgtaatccataatcgtggtagggtatctgaagaaaataggaaaaaggtacaggcgattctggagatggtacattaccagcccaatctgatggcacgttcattggcggcctccaaaaagcaatatcatcttctagcgattactccttcttttgttcagggagagtattgggaagctatttcggaaggtatagataaagcagcgtcggaaatggaatcgtataacatcaccattaccaaactctttttcgatcaatataataacaagacttttgatgatatcatccgtaatctgctgaatgagaaagtagatggtgtattgattgcgactttgtttacggattctgttatccggctttcgcaggaacttgacaggaatgaaataccttatgtgtatgttgactccaacattggagggcaacatcaactggcttatttcggaacggagtcttatgatgccggagtgattgctgccagattgttgatggaccggctttcttcgtcttccgatatattgatggcgcgaattattcatagtgggaagaatgactctaatcagggaaagaacaggcgcgaaggtttctgccattatctcacggaaacagggttcaacggaaatctgcatgaagtggagttgaaaataaatgattcagtgtataacttcatgaaactggatgaaatatttgaagctaatccaaatataaatggggctgttatcttcaattcaacttgttatattttagggaattacctgaaagcgagaggaatgcagtctgttaaattggttggttatgaccttatcgggagaaatacacagttgctttccgaaggtgtcataaccgcattgattgcgcagcgtccggagcgtcagggatatgatggtattaaatcattgtgtaatcatctgttgttcaaacagggcagtgaaaaggttaatttgatgcctatcgatattcttctcaaagagaatctgaaatattatctgaacaataaattataaacatataaatttgtaagaaccatgaatgaattatttaacgtaaaaggcaaagtagttgttatcaccggtggagctggtattttaggtaaaggtattgctgcgtatctcgcaaaggaaggtgcaaaagtagttgtgctcgacagaagtggagaagcaggaaaagcattggtagacagtatcaaagccgaaggaaatgaagccatgttcctttacacggatgtgatggataaagaagtgttggaaggcaacaaagtggaaatcatgaaggcttatggccgtattgatgtattgttgaacgctgccggaggtaacatggcaggtgcaactattgctccggataaaacttttttcgatttacagattgacgcattcaagaaagtagtggatttgaaccttttcggtacagtattgcctacgatggtatttgctgaaattatggtagaacagaagaaaggttctattgtaaacttctgttctgaatcggctcttcgtccattgacccgtgtggtaggttatggtgcggcaaaagcagctattgccaactttactaaatatatggctggcgaactggctttgaaattcggtaacggtctgcgtgtaaatgccatcgctccgggatttttcctgaccgatcagaatcgtgcgttattgactaatccggatggttctctgaccgatcgttcaaagaccattctcgctcatactccattcaaccgtttcggtgaaccggaagacctttatggaacaatccattatttgattagcgatgcttctaatttcgtaacaggtacagtagctgttatcgacggtggatttgatgcattctctatctaatattgggatggtatcattctgtttttaatcataattagtaacttgtaatcaggaaagaataatatgtatttatgtgaacaaacttggcgctggtatggtcctaatgacccggttagcttgtgggatattaagcaggcaggcgctactggtatagtaaatgctcttcatcacattccaaatggtgaagtgtggacagtagaagagatcatgaagcgtaagcaaatgattgaagaagtgggtctgacatggtctgtggtagaaagtgtacctgtacacgagcatatcaaaacacagacgggcgactttatgaaatacatcgaaaactataaggaaagtatccgtaatctggcgaagtgtggcgtgatggtagttacttataacttcatgcctgtattggactggacccgcacagatcttgcctatacaatgccggacggctctaaagcactccgctttgaaaaagcagcttttgtagctttcgatcttttcatcttgaaacgtccgaatgctgaaaaagactatactccggaagaaatagctaaagcgaaagctcgttttgagcagatgagcgaagacgacaagaaattgttggttcgtaatatgattgccggacttccgggttcggaagaaagtttcacagtagaacaatttcagcaagcattagatcgttatgacgatattgatgcagagaagcttcgttccaacctgatttttttcttaaaagaaattgctcctgttgccgatgaagtaggagtgaaactggtgattcatccggatgatcctccttataccatcttaggtttgcctcgtattttgagtacggaagaggatttcaagaaattgattgaagccgtacctaacgaatctaatggcctctgcttgtgtacaggctctttcggtgtgcgtgccgacaatgatcttgcaggtatgatggagcgttttggcgaccgtgtgaacttcgtacacttgcgcagtacacaacgtgacgaggaaggaaacttctacgaagctaatcacttggaaggaaatgtagacatgtacaacgtaatgaagagccttattcttctacaacagcgtcgtaaatgctctatcgctatgcgtcccgaccacggacatcaaatgattgatgacttgaaaaagaaaacgaatccgggatattcttgcctgggccgtcttcgcggattggctgaacttcgcggcttggaaatgggtattgcaaaatctatcctctaatcgaagtacatagttagcactttattatcaaacactacggctattattgattgaaataatagttgtagtgtttttcatttgctctttttcactggttgaggaataagtgaagcgaataaatctccaacatgtatatctttatcagctttctttgtttttctttcttttttcggttcgggaataataagtaaagctatttgtgcgcaagcctctgcatctgccagtgcgtggtggtgattctctaaatgatatccgcatcgttctgctaccgtatgcaactgatgattgggcaaatcttttccaaagactttcctcgaagtacggcaagtacaataaaacttataatcaggataagtcatgtcatataattcgtgaaccgcccggagacaaccttcatcaaaaggactgttgtgcgctacaagtggcagaccgtctatcaatggtttgatttccgcccatacttccggaaattcgtcggcttccatcgtgtcgtcgtaagttaagccatgaacagctgtggtccattgcgtataataattggggcggggacggatcagacgatagattttattcgttatttttccttcccttacgatgacaaccccaacactgcatacgctggtacgtttgccgttggctgtttcaaagtcgatagctgcaaagtttatcatcgtttctattattttttcggatacaaatatagcataaaaaatgaggttggagaaaatatagtaacaggattggcaaatagaaaccttttactaaaaattgaattaaaatggactttggggaaacatttccaataaaaaactcttcttttaaagaatttacactatttttgttcgacataaaccaaaggcatggacaaaatggaaaatccgggaccatttgccccctcctgtccaaatcaaattgatcccctgaatccaatctaaattgatcccttttgtccagctgaaagtgaccccttcaaattgaacgtacggatatactggtgatgttccgcttccggatatcacaacgaaagaaaaggcgcagcaatatatcggtttggatatggctgccgaaaaggtaggcaaagataaatttctcgaagaaattgtccctgaatggcttcaaaaggcaaaggcaaacggacgcatcgttgattagaatttattttcgctatatttgcgtacaaaatagatccatgtatacagaatatcagccttctcatttacttgttccctacattgatagctattgggagtttaagggcaatccggattatggtatgcgcatccatattctgccggatggttgtaccgattttatatttacgctgggagaggtggctaatgctgttgaagaagggagtctgattatgcaaccctatcgttcctattttgtaggacctatgacaaaatattcggaactcgtcacttatacagaatcgattcacatgtttggcgttcgttttttaccttgtggtttgtcttgctttacaaacctgcctctacacgaatttgtgaatagcagagtcagtactaatgagatgaaggctgtttttgatgacacttttattgaaaaattaggtgagcagaagcatgtcacagatcgaatacgagtagtggaagaatatttgctggcatatttggcgcgtcattatcagcctgccgattctcatgtcgctatggcagtgaacatgattaatcattccaaaggaaaacgttcagttcgcagcttgatggatgatgtctgtttgtgtcagcgtcattttgagagaaagttcaagcattataccggatttactcctaaagaatacagccgtattgttaaatttaagaatgctgtggaattgttgagaaccacaacatcagccaatctgttgactacggcagttgatgcaggatactatgatttagcgcatttttcaaaagagattaagtcgatgtccggcaatactcctgcgtcttttctttccctaaccgttccggaagaaaccacacttacttatatcgaaccacaaagatagattaggtaaaagtcgcttttttacaatagaatgggaagatatgccgttacctttgcaaggttaataaaaaacaatcaatttatgaccacaaaaacaatgaaagagaaagcaacagaattgttgcagagatgtgaagtagttacccttgcttctgtgaataaagaaggttatccccgtcctgtgccgatgagcaaaatcctggcagaaggaatttccactatctggatgtctaccggagcagattcactaaaaacaattgatttcttatcgaatccgaaagcaggattatgctttcaggataaaggagacagcgtggcgttaacggggaaagtggaagttgtaactgacgaaaagatgaagcaggaactttggcaggattggtttatcgatcattttcccggtggtcccactgatcccggctatgtcttgttgaaatttgaatcgaatcacgcaacttattggattgaaggaacatttatccataagaaactcgactaattctactcggaaagatagaggaatagcggatttaatgaggctgttctcgaacagcctcgtaattcatttagaattcaaatttttccaatttcatttcagccaatttctgaatgatacctacatattgagcgaaatgaggagatttttcgtgtgctgccaatacttcggcattctgccaagtttcgcaaatcatgaaaacgtcaggacgcgtgctgctttcgaaagtatcataagcaatgcatccttcttcttttaaagaacaggcagtcagttcttttgccgcttttatcgcttcttcgcggttggattcgtttacacgaacaaaaacatttaatctgatcatagtcttttttatttatataattaaaagaattgctttctcacagtatctgtgaaaagtcggaggcaaagatactatttttctatacttctggtgagtttatttcaaaaattcatataaacttcatgtcatcctaaaaaaacaattatatttgcatctgaattctaaaagcaatgattttgggcacaattcttaaatttgttatagcttaatattagcctcataaaccacaggctaatttctttcgtttgagtagttctatacttgaacaggtttttcattttatcatttttattattcactgcatcgtttttcaaaactgatgcaattaaggtattcaggcttttagtccggtttatgctaatcagatgggagtggtgggtgcgttgagaatgaatggaaaatttcgtaagaaatagtaagctgaacatagaagaagaaataaaaaggattgagcttcagacggttgatcctttggatagaatcaggcagatcattggtgtcgtacaggtttcactgacctcgctgaaaacagctgttgccggatatcagtttcgaagtgctgaagaagagattcttttctttaaagtatcgaaaccgcagatttccggtctgttgatgttttatgtccgtttgtatcagattgaaaagaatcgtatcgacaaatctctgtcatcccaatgcagatatctgaagattgaattggagaacctgcaaaaattatttttgaataatgacttttatgaatattatcgtgtcggtcggacagagcttgatagccgctatttcattcgggagaattatgatattctttctgatatacattgtcatctactggatagagatatttcttttaccaccttgcatgattcgagtgttgcagaaattttggcgaataatcgtttgatagaatatgtgtcggaagaaatagagcaactgacagagaaacttcatcttaaattcacttccattgtagacagtaaactgttgcaatggacggacagtaaagttgctttggttgagtttatctatgccttgtatgcaggtaaatgctttaataatggaaatacgagtttgaaagacattgctttttgttgcgaaacactgtttaatatcgagataggtgatttttatcgtatattcttggaaatcaggaatagaaagaaaagcagaacccaatttctggataagttgaaagaacagattataaagatgatggatgagcttgacagataaatttcagggcgtcttgtgacatcttgtgaattatacaaatggctattatccaactttgcggagaaatataattgattcacaaagaaagataatcgcttttgtatagttatggaaacaacatttacatgggagataagggtgaagaattgccccttattaattaagaaatgcagtcactgtgatagtgaccgcttttattgcagtgataagttcaggatgaatgcacagaagaaaaacattgatgtctggctgatttatagatgtgtgaaatgtgataacacttgtaatatgactctgttgtcacgaactaaacccgacttgattgataaaaagctctttcacagcttttctatgaatgacagggaagttgcctggcaatatgccttttctgccggagtggcaagtaggaataatcttcaattagattatgacagtgttgaatatgaggtgataaataccgtctctttagaagacatcctgaatatgagtagtgagatcataagtatccaagtcaagtgtgatttcgacttgagccttaaattatcctcattgataaaaagatgtctgcctctttccagtacccgcttgaagctgctgtttgaaaaagggtatatttctttactttccggcaaaacatcttccaagtgtaaggtaaagaatggcgatactattttgatggatcgaaaaagcctgattgatttcttgggataaaatcggttttacagttttttttaatagctttgtgaaatgataattcgcattctgtaaaagaggttgtactattaagatggaagatatgaaaaaggtatgtttattagcttttgttttgtttacttggagtatcgttgtgaatgcacaggaaagtgatggacgatacgttgaagtgaccggttcttctgaaatagaagtcgttccggatgagattcattttctggttcagattaaggagtattggcaagaagaatacaccggtaaatcaaaaaaagaagaagattttcatacgaaagtgccattggcaatgatagagaaagatttgcgtaaaagtttacgcaaaataggaataacggatgatgctatccgcacacaggaaataggagattattggcgtcagagaggaaaggagtttctgataggtaagcaattggatatccggcttacggattttgagcagattaactctattattcgttcagtcaatacgtggggaattgagtccatgcgcatcggagaactcaaacataaggatttgccaatgtatcggaaacaaggtaagattgaagcactgaaggctgcccgtgagaaagcatcttatctggtggaagcgatggggcagcagttgggtgaagtgattcgtatcatcgaacctgccgataataacataagccgttatcttcctttcgaagcgcagagcaatgtaagcatgggtgcggcagctaccgagcagtaccgggttatcaagctacggtatgaaatgatggctcgttttgccattaaataaaaatagtctatctttgtcgcatgacaagaaataataaatcggatttggtttagtaaacaatctgtgtttctgatacagattgtcctttcgtttgctctcggatgattccttccgggagtactctttatgtctttataatttcaatttttaacttgcgtacaagggtgctaaaagcatcgtggtgctttgtaacgtgtacgctgtatacattaagatcatgaataacgaaaatcaaacaattcacaaattcgactttaatttaaactggtatggctggaatgataaactaagccaactaaaacaagaatcactctacagcactcttcctcatggacgtatatccatagtacatcgtacctgctacgaggtcgtttccgaaaacggattgtttcagtgtgaactcacgggaaacatgatgtatgggaaatctgatgctgaattaccctgtacgggtgattgggtgctttttcaaccatttgatgagaataaagggattattgtctatatgctacctcgtgagcggacattgtatcgcaagaaaagtggtacagttgccgataagcaggccattgcttcttacgtcgataaagcatttattgtgcagagtcttgacgataatttcaatgtccgcagagtagaacgttttatggttcaggtattagaagaaaacatcaagcctgtattggtacttaataaatccgatttagattttgacaggcagagtgttgaagaacaaataaatcatatctccaatcagatacccgtattttttacgagcattcatcaaccccaaacgattctccggttgcgggaatccatatcagagggagaaactgttgtgtttgtcggttcttcgggtgtcgggaaaagttctctggtaaatgcactctgtgaaaaatctgtgttgcttacctccgatataagcctgtccacaggaaaaggccggcatacatcaacccgtcgggaaatggtattgatgaatgattcgggtgttttaatcgatactccgggtgtgcgtgaatttggcttggttatcgacaatccagactcactggccgaagtacttgaaatctctgactatgcagaatcgtgccgtttcaaagattgcaagcatatcaacgaaccgggttgtgctgttttagaagcagtcaatagcggtgtgttagattataaagtttatgcaagctatctgaaacttcgccgggaagcgtggcacttttcagcttccgaacatgagaaacgtaaaaaggagaagtcctttacaaaacttgtagaagaagtaaagaatcgtaaggcaaatcgctgatttctatttaaacgatgcaggtattggaatttatttttttctttaaaagagcaaaaaagttttagttgcgcaaaaaggctgcgcaccactgcatctatctttgtcgaagaaacaagaaaacaggtcaagtacgggttacttccatacatcctgttaagatattgactcatacgattatcagttttcctgtttcgtaaaggggcagtagctcagtgggtagagcatcatacataatcttgagattatcctgatgaaaaaggtcaattaagatttacttctatcctgtgatggtcgtcggttcgactccggcctgctccacaaaaaataaatatagaggtaggacagcagcttcgggattatctgaaatgaggtcaaccggggcttacttcttaacggtggataacgctggttcgaatccggcctgttctacctctttttatcaactaaggtcaaggaagacttacttcaaaaccgcaggaatgctccattgattcacagtcttccgattaccttacttaaaaaaacaaagttatgaataaagatttgttgaaagtgtctatcaggcagaatgcaatctatttgcctttgatagaagaagagaaaaagcaggaagagttgacttcgactaccattgcattggtagcccaactccgtaaagtaggatatagcttgtccgaagaactgctgcatgccgttaatcagttatatccggctcaacagatgatgattcttcaggtgatgaaagaagcattgggcgtgacgctaaactgggctccattggtgaaagggtgggatgtacctaccggagaaacgcgcttggatcatctggttacatggatcgctaacctgtttaatagccagaaaggcgttaaactaccttgcggacacgtgatccctgataatacattccctatggaacgatacaatggttgtccgttctgcggaaccccgttccaaacggctactacggaatatttcggacagggaagtaaactgaaagtgctggaactttggcaggacaaggagctgaatgcttttttctgtgacttgcttgaatcgcgtacagctcttgatgccacacaagcggatagcttgaaaataatgcttggcgaacttccgttaccggcagtcggaatcaaaatgaaggagacattgatgttggtgatagatacattggtggaacaggatagagcgcaggaagcgcaaatctatttctctactccgaatgatatattgcgttatctgtggtataagaaaaccggattcctgcaaatcatagagcctaagactattatccgtaaaacaggtagaaacaacacacatatatgtggagttttggataaaagtcgttcggcagctcaagcgaagcgtgaggagttgaagttgaaatatacgcgtcgtgaatgtaaaatggtagctctttggttgaacaacctgacaatggctccggagaaggcttgcgaaatcatgcatccgaaaagagagatgtgggtacgtatgatacgtgcgttgcgtctggcggaatatgcccgtaagccggaattcggaaatttgaaggaattgatggatatattctaccgcgaggcatataccgtttggcagggagaagtggagcgcaaccgtttgaaggcggatgcggaacagacatttgctttgttaaagcagcgaccgggtatgtttgcacgttctttatttgcgaatatgctttggttcggagcggaagagacgttggctgcatttaaagaagtggttcatttgttgccggcacgtttggtagttactttgggtatgtatgcggagagctactttgaaccgggacgtaagagaatggtgaaacctttaggggggaatgctcttttgatagaaccacattatttggtgggtctgtatatggaggatcagctaaaagcgatggtgaaggatgtacaggatttgtgtaaggaagtcgtagctgcccgtttcgccagtgcaactgtcgaaagtgaaaacaaaagtatgtatattgaccctatgttgttccatattccgttggctatcggcgatcgtagcgaaacaattcaggatacttcctgtgctttgcagggaacgcgtttcccggtagagggggataaagtgcgattgtttatgcagtggggaaaagggcttccggcacagcatcttgacatggacttgagttgtcatatcactttgccttccacaacagaagtttgttccttcttcaacttgcaagctattggcgctaaacatagcggggatatccgaagtattcctaataagaaaggtactgctgaatatatcgagctggatttgaatgaactgaaccgtgtaggtgcggaatatgtcgctttcacttgcaatgcatatagcaacgggactatctctcctaatctggtggtaggttggatgaactctgcctatccaatgaagatatcggaaagaacaggagtagcttacgatccttcttgcgtacaacatcaggtacgtatttcccaaagtttgcagaaagggcttgttttcggagttctgaaagtgaaagaacgggaaatcgtttggctggaaataccttttggtggacagacgattctttctttggatacacagaccattgaaaagtatctggataagctggaagcgaaaacaactgttggtgaactgttagctgtcaaagcacaggcacagggattgaagttagttgatattccggaagcggacgagatatatactcgtgaatgggcattgaatactgccgctgtgactaaattactgttgggtgattaaattcttgggaggaattgtctttttcctcctaagatttaaaggtcgtatcgcataaagttatacctttgtatgcgatagattaatcgtctgacagctgttgaactttcgtctgacaactgttatctttccgtctgacaactgtcagacgaaaaagatacagctgtcagacgattatttttatatgaactgaagattaaagttcaatgaacaggcgattaaatatacgtagtgaaagtaataaatgtatgaactaataaaaagatatacttatgagtgctcaatatgatttgtatgaaacaccggatcctgattgtaccggagaacaaaagcctttgcatgcccgtatcgttccaaatggaacttactcgaagaaagaattcatggaacgtgtatctcgttcttcccagacttttaactataacgtgatagatgcggtagtaggagttgtattggatgaactagccgaaacgttagcagagggatatatcgtagaacttggcgaactcgggcattttagcatctctttgaaatgtacgcataaagtaatgactaaacgtgagattcgtgccgaatcaatctgttttgataacgtgcatttgcgcacttccaaagagttcaaaaggaagattaagcgtgaaatagagttggaacgtgtggataaatccaaacactcttctcaaaaagtggaattttctatggagcaacgccaacagcttttacaggaatttctaaggaaaaatggtggtattacccgattggaatatagtagcctgaccggactttcccggctgaaagcaatagatgatttgaatactttcattgagaaagggattcttcgtaaacgtggagctggaagaaccgtgttttatgtttggcaacaagagtaataacaatcaattcaaagatttcttcttgttattgctaacaattttgtacctttgtttgtctatagaaaaaatagtaggattatggcaagtataacaattccttatgcagtagcagatttcatagaaatgcgtgaacgtggtttttattacgtagataagacccaatatatagctaagcttgaagattataaggctcctgtatttctgcgtccccgtcgctttgggaagagtttgttagtctctactctagcttgctattatgaccgtacgaaagcgcatcggtttgaagaattgtttggtgacacgtggattggaaaccatccgacaaaagaacataaccgttatatgataatccgttatgacttctccgcaatggtaatgtcagaccatattcaagggctggcacagaattttaatgacttgaattgcggtccggtagaagtaatggtagcacataatcgtgatttgtttggtgattttgaatttagcaatcgtggcgatgcatctaaaatgctggaagaagtgcttacttacgcccgctctcacgaattgcctaaagtctatattttgattgatgaatatgataatttcaccaatcaattacttactgcctataatgatccactctatgaagaagttactactaatgacagctttctgcgtactttttttaaagtaattaaaaaaggtattggtgaaggtagtatccgtacttgtttttgtacaggtgtgctgcctgtcactatggatgatttgactagtggatataatattgcagagatattgactcttgagcctaatttcctgaatatgcttgggtttacatacgaagaaactgaaacatatctacgttatgtgcttgataagtattctacaggacaggatcgctttgacgaaatatggcaactaatagtgagtaactatgatggttatcgtttccgtccgaatggagatcggttattcaatgccactatccttacttacttcttcaagaaatttgcagccaatgccggtagtattccggacgaattggtagatgaaaatctacgtactgacattcattggattcgtcggttgactctttcgctggataatgcgaaaacgatgttggatgcattggtaattgacgatgaattgccttataatgtggctgatcttgctagtaagtttaataagaaaaagttttttgataaagagttttatcccattagtttgttttatttgggaatgacgacgttgaaggataaatttgtaaccacattgcctaatatgacgatgcgtagtgtatacatggactactataatcaactgaacaaaatagaaggcaatgcacaacgttatgttcctgtgtatcggcactatgattccaatcgaagcttagaaccactcgttcagaattatttcgaacaatatttgggacaatttccagcacaagtttttgataagatcaatgaaaactttatccggtgttctttctacgaactggtatcgcgttatttaagtagttgttatacctttgccatcgaacagaataattcagtaggccgatcagactttgaaatgaccggtattcccggtacagattactatacggatgatcgtgtggtcgaatttaaatattattgtatgaaagaagctgaaaagatgcttgcgctttccgagcctcttcccgagcacgtggaacaggtgaaaagatacggtgaagacactaagaaaaagtttcctaattataatgtacggacatatgtggtgtacatttgtgctaataagggatggaaatgttgggaagtatgagacaataaaatctgcaatattgcactaactgtttatgaaaaatgagagtcatattatctctcgaatgatttccggagatataaatgcttttaaacttcttttcgatcgttactattctcaagtgcgtttcttcacattggggatagtgaaagattcttttgttgccgatgatatagctcaaaatgtatttatcaaggtctggacaaaaagagaattgattgattgcgaacggaagtttaataactatttgtattccatcacaaagaatgagataacagattatttccgttccttagtcatttcagaacctttggaaagcatttcatatctgaaggatagcgatcatacagatgaaatgatagaaagtgtttatgatctgtcacatattaaagaactggtgatgaaagaagtggataatatgcctccgcagcgtcgtgcagtgtttgtcatgagtcgtttgcaaggattgtctaatgatgagatagcctctaaactaggaatatccaaacgcacggtagaacgccatctgaatatagcgttgcatatacttcgtgaaaaactgggaggatttctttattggattgctgttttgttcattctttctctctgattttaatttttccgctctgccatactactttttgttacacctctattcccaattaatagtttataaatgttaaagtcgaaaaagcattgggtgtactttttctagcttccgtatatcagatataaccagataatacgaagaaaaatgaaactcttacctcccggaatattgaaagactatttctataacttgaagaaggatatcacttcaagtgcgtttggacgatggttcatagagaatgagtctaaaccggaattcgatcaggaattgcaagaaatttggaaagaatcgtctcaagtagcctgtgaccgcgaaatgacctcttctgcatttgtgaaggtctgtgaagctattggtggagtagctccgtctcctcaaaagagtacattcacgagaacaatacattatctgatacgtgttgcagctattctgtttattcctttattgggagctactctttatctatatctggataacaaggaatcacaagtcaactggatagaagtctatgccgaatatgggcaaaagaaagaagttattttgcccgaccagagtaaagtttggctgaattccggtacacatattatctatcccgaatggtttacccaagttcgccagatatttgttagcggagaaacctttctggaagtgacaaaagatccggaacgtccttttattgtagatacaaaagatttaagcatcaaagtgcatggaacaagatttaatgtacgttcttatacggaagataaaggcacggaagccacactgcttgaaggaagtatttctttgttggtgaagggagatttaaatcagcaggatattttccttgttccgggtgagaaagctatactggataaaaaacaagttaaacttgaaaagtttgacgtcgatgggtatcaatcctggcgaaacggacagtatacattcagagacaagacactgcaagagattataacggaacttcaacgtctgttcaatgttcagattgtgataagggataaagcgctactcaaagaaattttctttgtcacatttgcccagggactttctttggatgagatgctcgaagcattgaatatagacaatgaattatgtatcaagcgagatcaggatattattgaaatttcaagaaagacgagatagacaacccagttattaaccttaaaatacatgtgcggaatggatggataaacaaataaaaaaataaacgagaaagtggttgcgacactttcccgttttggaaatcagttaacaaaattaattattaacttagatcattgccaaaggtatgaaatatcatgaaaaaccggctcattttagagagctatttagcaatcttttaccaattctattggcgctatttatctggacgaatccggtattggcgcagaataatggagaacttatcacgcttagtctcaaaaataagacaattggtgaggcgttggaaacaatcaataagcgatacaactacacgtttgttcttcgaacaccggatattgatacaaaaagaaaagtttcaatagacgccaaacaacaaaagatcgaagatgtactgaataatctgtttcgggggcaggatgtctctttcgatatcaataacaaaactgtccgtatctccaagaatgtcaggcagaaagacgcagaatctacacagggggctactgccagaaacgtgacaggacaagttacggatagttccggcgaaccgatgataggtgtcagtgtgatggtgaaaggaagtaataatggagtggtgaccaatatggatggtaagtacgaaatcaaaatcgatcatcctaatcaagtacttcaatactcttttctcggttatctgtcccaggaaaaaagaatcggagacaaccggatgctgaatgtaactttagaggaagatgtgaaaaaactggatgaagtggttgtagtaggctatagcgtacagaagaagaaagatataacgggagctgtatccactgttctggcaaaagatatagaaaatattcccgtgaatgatttcgggtcggcacttgccggacgttctgcgggagtacaagttatcaccccttcggggaagccgaatgagggtttctctatccgtgtccggggagctacgtctatcaatgcaggaaacgaacctttgtatgtggtggatggagtgccgaccagtgacacaaaaacgatcaacccttccgaaatagaaagtattacggtattgaaagacgcttcttctgctgcaatctacggaaatgcaggtgcgaatggggtagtactgattactaccaaaagaggccggaaaggtgaagcgcaaattgagttgaatgcctactatggtttttcggaacgtgccaagagaatagatgttttgaataaagatgaatatcaggatttactttccgatttggggtatccggccatggatacctccgtgtataatgccaatatcgactggcaggatgaaatgtttcgcaatgcggccatgcagaattatcagttatccatttccggtggaaacgaaaaatccctttattacatttcagccggatttatcaaacaggatggtattgtaaaaccatcttcatttgaacgtatgaattttaagatcaatctggaacaggaattgaaaaaatgggtaaagatcggaacgaacctaagttacagtaagatcaatgatgtcgatgtttcggatggaaattccgagaccgttattctgcaagccatcaccactccatctgtggtaggtaaatataatgcggacggaacatttcctacgctaccgtttttgtcttctttggagaatcctttaagtgcggtagagtcatatactcgtgattatgtatatcataaattgttgggtaacctctatgcggagatttcttttactccggatctgaagttaaaaacaagcatgggcatcgaaatgggtgcttcccggtacaaagaatttctggacccgttcagttcagcttggggacgtaaccagcagggacaagcgagttataacacttcgttaaattacaaatggatcaacgaagaaattctgacttatactaagaagataggagatcacagtttctcggctttggcggggtttgtggcttcccgctatgtgggagaatcggcaaacagttctatacgtggattctctgataataaaatacattctatgaacgccggaactgtattaaacaagccaagtgaagattatggtgcatctaccaatgcttctgtattggggagagtgacctatgactaccagaataagtacctcgccactgtcaatttccgtgctgacggttcttccaagtttggagtgaacaaccgttgggggtatttcccttctttctctttgggatggagactgactggggaggaatttatgaaaccattggattggttgagtgatttgaaactgcgtgtcggctggggacaggttggtaatgaccaggtgggttattatagttcttatgggatttatggaatcggagccaattataatatggatggcattattttaccaggatattatcagagccagatagggaatgataagttgcgttgggagagaactacccagaccaatgtgggactcgacttctctttccttaatggaagaatgacgttgactgccgatgcatactataagaaaacaaccgatttgctgttaatggtaaagctgcctcaaacttccggattcgattcgggtatgcaaaatgtaggtagcgtggtaaataaaggattggagttccaactgaccacgcgtaatctgaccggagaactaaaatggacaacagattttaatatctccactaataagaatgaggtgacagatatggcaggaagtcctgctatctttaccggatcacttgataagaaaatctccggaaatgtgtctatcattcagaaaggacaggctttaggttctttttatggttttcaggcagcaggagtaaacccgcaaaacggacgtatgatgtacgaaaaggctaacggaatgttagtgtatgaagaagatttgagtgcagatgaagaccgccggatcttaggttgtgcacagccgaaatttctgtatggcatcaacaatgttttttcatataagaattttgacctgtctttcttctttcagggttcatacgggaatgatatttataatgccacccgtatgtttaccgaaggaatgttcgactcccgcaaccagtccgaccgtgtcctgatgcgttggcgtaatccgggagactacactactgtgccccgtgcggagaaagataaatacccggctatttcttcccgttttgtagaagacggatcttactttaaactgaaaaatgtgaaactgtcatatactttgccgcgtccgctgacccggaaggctttgatggacagagtgacggtctatatatcaggggataacctggtgacttttaccaattacagaggttatgacccggaagtgaatatcggtggaggcagttcttcggctatgggaatcgaccagggtgtcttcccccatgcaagaacttatattctgggagctactattgtattttgagcattgttcaactcattaaatctaaaaaagacatgaaacagatatattctatatttatatccgcagctttgctgctcaatgtagggctgacctcctgtgatagtttcctgacagaaacaccgcagggagaactgaccgaagccaatgcttttacttccataaaagatgtggaagcactgattatcagttgctatgacggaatacagaaggggcatgaagaatattatatgtggtattatatgattcttgcagactgttttgcggataatgcatacagtggtggtgatgatgtggatatcaataatgtgttcttacgcgacctgactccccgtaatgcggttgttatgaaatcatggaagtcgctttacggaagtattatgcgttgtaacgtagctttgaaatatatacctcaaattaatgatccgttgttggacgcggaagcttttaccggagtgagtaaacgtgaagaaatgcttggagaagcttctttcttgcgggcgttgcattattttaatttagtaaagacctggggatgtgtgcctgttgtgactactacgggaagcactgctccggctgatgtgcaagtgcctcgtgccgattcggaagaggaagtttatgcacgtatcattgaagatttggaatttgcgttgacccgtttaccggacaagcgtgctacggaagctgaaaccagaggatttgccagtaaaggggcggttaacgctttgtttgcaaaagtgtatgcaacgaaaggtgcacccggcaatgtagaatgggataaggtgaagacctattcggaagcagtgatgaattcgccggtataccgattggtggatacgtatgaccatctgtttgacgatgaacatcgtaataatagtgagacgattctggctgtacagtatatcgccaacagtacggaaaataattacgtacctgttcttctattgcctccttccatgacagagcagaattggcgtaaatatctgacaccttcccaaagtttgctgaaagcttttgatgatgaaggagatcaggttcgtaaaaactctacggtcatctttgaggacattaacaatatttggttcgaccagtattatgcgcaactgaagaatggacaatgggaaacccgcacattgcctttcccttacaagtgcagggcaaagaatcgggtaggatgggattgcggagacttgatctatattttccgtctggctgatattgttttgttgcatgcagaagcagtcaatgctttgtccggtccggcaactgcaatagcggaacccaatctgcaaaagattcgtacccgtatcggacttcaggaattgaatgccagttcaagagaagaactgacccggctccttttgaaagaaagacgcttggaactggcttacgaaggagagcgattctttgatttgaaacgttatggaattgctcaaagcaccctgtcaagtctgacgtggtcggaaattgtggatggagaacaaacgactgttacgggtaaattccccgcacacatgttgctgatgcctattccgcaggaagaaagggatcgtaatccgaacctaactcaaaatccggggtataattaatcctcttcctttattaatctttaaatgaagaaatatgaaaacgaatttatataagcttgtttcattctatatatttatcgggttactggctgtttcttgccagaatcaggatgaaatgtttttcgatccgtctgccgaagcacctgtcattggaaagttatccttgaatcaggaacagttgcaatatggtgggtcggtaaaattaaacgtggaggtgacggatgcagatgccttgtcgcacgtagaaatacgcttggttgccaatcaggcggtgctttattccaaaactcttccgggaaataatcaaaagacattgaaagtggaagaagaaatcgaagtgccgttcggacgtttgtgtggcgagcaacttgcttctctggaggttgtggctacaaataaaaatgtgaaaacagcagaacaatcttacgagattccattggaaaggccggattttgcacaattatatgtagtggttggtgaaacaggggaagaaattgtgctgcaaagggatgaaagtaatccgttaactccttatttatataaggctactgtagacttgccgaataatacaaatgtgtttatatatagcgagccggaaaagaaaggaatggtatggggatttgatgccagtacgaatacttgcgagttggcttcgtcgcgtccggtttccctttgtgattcacagagtacggaagagaaagtgagagaggtggtattcgatgctttttcttttgagatttcacctctgaaaaaggaaatgacggtaaatgatgttgtcttcatgctgtataagaagaatgcgtcggataatgattttgtaagcaatacacttcgtgcccagaatgtttctttgacaaacggtgaagaagtgaggacagaattgattgatctcaatgtgttgaagtttgatccggatttctttaaactggaaggagataagttgatgtatatcgggcagacaggtaatgtgacgttatatatgaatacgatgttcaactttgtttttgtagagagtgcggaaaatccgttaactactaatgtttcctatccggaagttttgtttgtgaatggttggggaatcggtcgcccggaattgtggaactataatccggattgggattttaataatgcggttattttccgtaaagtatcggaagatgctacccaaacagtttactcgcagactgtcattgtcagtaaatgggttcaattcaaattctataatcaaaaagactggggaggtgagttctcttgtccgaatataacgtttgaagatgacaactttaaagccgtagaagaaagcggtaaaccgggaaattataatatatcaccttcgttgggcgatgatacgagttataaatcagcggttgccaagattacatttattgttccgaaatcgggaaatacaactcatttccggagtactattctggtagagagtgacctggattgagtaatcacttatcattaaactaatttgtattatgcataaaaagattcaatatatattattgcttatgttatttacctgtttgatacctgttacggcgaaaaacaaaagccggatcagtctgaatgatgaatggcagttcaagcaatctatatctcaaaattggctcccggcacaagtgcccggagccgtacataccgatttgatgaataatcgtatgataaaggacccgttttacggagtgaatgagaaatccctgcaatggattggagaaaaggattgggaatataaaaagactttcatagtagatgaggctctgcttcaagcgcccaatgtacagctagtttttgccggacttgatacgtatgccgatatttatatcaatgattatctagtgatgaagtgtgacaatatgtttcgtacatggactttgaatcctcttccttatttgaagaaaggggagaatactatccgcatctatttccattctatatttaaggtggatatgcctaagtacctggcgtctcctttccagttgcaggcatggcctaataatgatcagtcggatattatgttaagcctttatgcccgcaaagccggatataattatggatgggactggggccctcgtttgattactaccggtatctggagagatgtttatctggaatactgggatgatatccatatcgatggaactcaaattattacccggaaactggagtcgggaaaagcgaagatggaggctgtttgtacggtgatgagtgatgaggatacgaaggcaacgtttacagtggaatatgataagaaagaggctgttcgtaaacaagtagcattaactaaagggatgaacacggtacgggtagacttcgaagtgaagaatcctgaattatggtggactaacggattaggcaatccccggatgtatgatttcgatattgtattggataaagaaggacgtaaggtgacagaccgtgtaaagacgggtatccgtacattggaaatagttcgtgaaaaagatgaacaggggcagtcaatgtttgtgaagctgaatggaaaagcggtctttatgaaaggagccaattatattcctttggataattttccgaacagggtgcctgaaagttggtacgaatatatcatcaagtcggcagctgatgtgaatatgaatatgttgcgtatttggggtggaggtatttatgagatggatgcgttttatgaaatgtgtgacaaatacggtattcttgtctggcaggatatgatgtttgcctgtggcatgttccccgctgacgagcattatttgaatagcgtggccgaggaagtgaaggataatgtaaaacgcttgcgtaatcatccttgcattgcactctggaacggaaacaatgaaaatgagatttcatatttcggatggggatggaaagatcgttatacgcccgaagaagacagaatttatcagagtaatctgcataaactcttttatgacgtaattccggaagcgatacaggctgtggatgaaacgaggtattatcacccgacatctcctgtgaccggctataataatatagattataatatgggagatgtacacttctggtctgtctggaaaggaggatggcttgaagagtacacggaagctaaaaacataggtcgctttatgagtgagtatggttttcagtcttatccggagatgcgcaccatccgtcgttttgcaagtgaacatgatttgcgtttggattcggaagttatgttgtctcatcagcgtgcccgcaatgaccagactcgtgatccgaatttcgggaataatatgatgaagatgtatatggagaaatattttaaagttcccgatgattttagtgcatttgtttatatgagccagtatttgcaggcggaggcggtgaagattggaattgaagctcatcgtcgtgcaaaaccctactgtatgagaacactttattggcagattaatgattgttggccggtagcttcgtggtcaagtattgattattgtggcagatggaaggctttacagtattatgcccgcgatgcatatgacgaggtattggtttctccttatgcttccggaaaacaagtcgtattcaaggccatttccgatcgtttgcaaaagatgaaaggagagttggagataacgactctgactttggagggacagacggtgttctcaaagaaagtttcatttgatttgggtgctaatgggtgtgaagatgtggcttcgataacaactacggaactttatggaggtaagaaagagaacgaagttttcatttatgtgacgttgaatgaaaatggtaaaactgtttcttcgaacatccattatccggtctactccaatcagtatacttattcaaaggtggctcctattataacggtggagaagaccaatgaaggagtcaatttacggcttcgttcttctgcactgattagagggctttatctttatgtagatgacgatgaaagtttctttgagcagaattacgtaacgctgataccgggaaaagaggaagtggttcaggtgaagactcatctttcagcggcggcttttgagaagcaattgaaatatctctcggtaaatcaagtcaattgattgtgaaatgtatatctcaatcggacctattaatacataataaaaatgaagaagataatgaataatatattggcagcttgtctgctttccagcctgatagcttgcactttggatgatccctatatgccggttaatccagaagaaaaaccggctcctcctgtggttacggagtatcagcctgtcgctttaacgataggggctaatggtcgttttgatgtttccggttcctctgtaaaaatagggttaaacgggaagaattctacttatggtgtttgtctaccacagattgcgcagggacattttattgcggaggtaacagctgataaaacaactaactttggcttggctattgtccgggagaagaacgggaaaccggatttcaataattatacttcggtgagtgtgtgtacagaatccggtgtgtcgaccgtacgggtattggatcgtcaggacggaatagataacgttttggataatacgaagaagataaataaaaatgattattctttccgttattccatacctctcaataatagctatttttctgttccttttacagcttctacaggtaaggcacgtatcatcaggaataagatatccggtttctttcatttttatgtgagtgttggaaaagaaattgatgggaaatttcatgagaactggattgaacttgctcaatcgaaagattggggaggacagggacagaactattttatttgtccgatagtcaggaatggtaatgaaaactcgacagaagtcaacttttcagatattcgttttgaagagttttcggctgaagatgtcgtggagtcctctccggaatttgatgtaaaacagcgtaattttacatgggctggctttccgggggatgcgacggtaatcagtttcaatccgaaacattgcccggctgctgcacaaaacagacaatttgttttctggtcggaggcaaactttgtacctgcttggcacatgaataacgaattgctttattgttatgagtttgctgaaacatggtcggatttgagtaaaggatgcttcgagccaatgtcggatcgtttgttggcgcatgcgaaagtggatatcatagagaataataaagtaaggaaagtggttaagtaccattatgcgttggtaaatccggattataaggctccttatcctgacgggatatatccggaagtagacgagtattatactttctatgctgacggagtaggcgtgagacgcatcgagtatattcagaaacaggcgggacaggcttattatcgctatcatgagttgagtgagcccatggttatttccggcagttcatccattccgtcagatcatgtgaaacaaccggcttttagtatttctaatctttcaggcaaccggtatgatctttatccggctaaaccatttgatgaagtcaaccagaatgtgaaaaactggaaagagcaaatctatactgctcatttaaataatgctcctgatgctttttctgttttctcttatactcctgaacgtccggaagtctctccgttgccgattgagaatgacttgacctggcatgatataaattatcagatgtctcattggccggtagataaacaaccctatttaaatgcccgttatggggattatgataagtcaacggctacctggccgtcacaggtctctcattcttcattgattggcgtggaggctaaaggggacgtttcctggaatactgcttatcagattaattcggatggaaataaatatagagtatatttgatgctgttgggtatcaatcaacctgatgcggcttctgatatagatgcgtatacaagaggatggctgtatatgggaagcccgacgaatctgaacggagtttcttataatccagatgtaacagggtattccaaacgggagatggttttgatgaaaacgacaggtacaggaagttgtcagtttacttgtaaccctaccggcgcagtgaagaatcctgtatttagaattgataattggaccggaagcggaaatgtaacggtcaaggttggtggaaagacgttggtgtctgatagtgactatttgagtgataaagtaggaggaagcctcgtaatctggcttaataaaacaatatcttctacattctctgtcgaaattattccggtataaaatgatcctttggagaggacttctcaaatcctctccaaaggaatttaaataaatcaagagaggttggccttttatgaaatatatactattcattcttttgttttttctctgtttatcctgttcacatcgtccggttcaggaggttgatacagtttcttacagagggtgggagaactgccttaagctatctaacagggctgtttccgtaattgttaatccgacgtatggcggacaaattctatatttcggcttagagagtcgtggagataatatattgtggagtgattctgttatcaacggttggactgtagagaactatatacgaacaagacgaagtcctgatgccggtagatttgatatcggtaatgaacgtagaacggagaatatccatgattcaatttgggcaggaccttatcaaacctttattgaggaagataaattgcgcttggtcagccatccctcacaggcgatgggtattcaggtggagcggatttactttttggaagagaaccagccggttctgcatattaaacagcgaatgtctaatatttcaaatggggaggttgaatattgtttctggacacgtacattactgcctgccggtgggatttactattgtgaagcgatgccaaattcacaatatccattgggatttagtgagatttcattgtcagcagatacattaattccctctcatcatctgcaggaacgtattcatgtagagaatcattattttaccgcatttcccggaggagacgaacaaaagaaatatgggataaatactacaaacggtatgtatttctatcagttcagtgattatttgtatatcaaacaaaataagtatgttccacaggggaaatatgataataatttgcaggtgtgttttcctaacatgatttattttaatgatgaatttttggaaatggaaccgaacagtcctatggttaaactaaagccgggagaggcttatgaatatgaagagatttggacattaagggaggtgaactctattactgataacacatattaagatgtataacttgctgattatttttcatactgttatatttgtcccgctattctattaatcaatagagggagaatgtatcaaaagaaaaatataagggtatatatagcatggatgttattcatgacattcattcccttctttgtagtgaagacctttcactatcatggaagtgaggatgaaaagtcgtgttcccatgcaaagcattctcaccaatcatctgatgattgtgcgatctgccaatactccctttctttctttactgaacctcaaccgatagaatttcattgcacactgacgctcgtgccctacgagccgattatttaccaggataaggttgtttgcaaacgaacttattcgcatcatttacgcgggcctccggtcgcatgattacatactcatattttcaatggagatagattggctttcaatctatccttacattcattttacacattaaataaaagattgtaattgatgcgtatcggaattatttcgggcgtaatagggctatttgtaaccttatccgtccatgcacagaaatccgattcaatcaagagcatgcttttgcctgatgttgtggtaaccgaaacgtaccagcaacgtcaagcgaaaaagtctgcccttacggttgatgtagccgatcaggattttttgcgcaaacattttacaggaaacttcatgcaggcgatggagaatattcccggagtacaggcaatggatattggttcgggcttctccaaaccgatgattcgcggaatgggattcaaccggattgctgtattggaaaacggaatcaaacaggaaggacaacaatggggagccgatcacggactagaactggatgctttcaatatcggagcagtcaatgtattgaaaggaccctcctcactgctctatggcagtgatgcaatgggaggagtgattgatgttgttccgtcggctgttcctgctgataatcgtgtattcggagatgtcacactgctgggtaaatcagtcaatggaaccatcggaggatcactgatgctgggaatcaggaagaatgcctggtactcccatattcgttattcggaacaacatttcggtgactatcgtattccgacggattctattgtctacctgacacaaagaattcccatatatgggcgtaaactcaagaatacagcaggcattgaacgcaatatcggactttttacccaatatcaacgaagagcctataaagcgaattatgctgtgagtaatgtatatcaaaagacgggattctttccgggggcacatggcatacccgatgcgtcacgtgtggaagatgatggagacagccgtaatattgaattgccattcagtaaagtgaatcacctgaaagtgaccacccaccagcaatatgcatgggagaaactgatcttgtcaggcgatttaggtttccagaacaatcaccgtgaagagtggagtgctttccatactcactatggttcgcaacccgcaccggagaaagaccccgacaaggaacttgcttttaatctgaacactttcagtgcttcggtgaaagctcgttttattggttcttcttcgtgggaacatatattggggtgggatggacaacatcaacggaacgacatttccggctattcgtttttactgcctgaatatcgccgtttcactaccggaatgctttggcttacgacatacagacccaacaatgtgttttcagtcagcggaggagtgcgatatgactacggatatatgaatatctcttcgcatgaagatacttaccttgccgattatcttcggaaacagggctatgatccggaacagatagacttctacaagtggaacagtcactctgtgaataagcactacggtgattattctctttctctgggattggtatggactccctccgacaaacatctggtaaaggtgaatatcgggcgtagtttccgcctgcccggtgcgaatgagttggctgccaacggtgtacatcacggcactttccgccatgaacagggagatgcaaacctaaagtccgaacaaggctggcaactggacgcttcttatcatctgaagtaccggggaatttctttctccgtctctccatttgtcagttggttcagcaattacatctttctgcgtcctaccggagagtggtctgtattgcctcatgccggacaaatctatcgctataccggagcagaagcgctatttgcaggaactgaagctaccgtagatgttgattttctgcgcaacttcaattatcggatttccgctgaatacgtttacacctataattgtgatgaacatattccattgagtttctcgccacctcctgttatgcgcaatacattaacctggcaaaagaatcggtatatgttgtatgcagaatggcagagcattgcccggcaaaatagagtggaccgtaacgaagaccgtacagccggagcaaatctctttcatctgggtggttcattgaatattccgataggtggaaacaatgagattgaaataaccctgaccgcccggaatatattcgatacccgatattacaatcatcttagtttttacaggaaagttgaaatccccgaaccgggacgtaacttccagatattaatcaaagttccatttaaaaaattactgaaatgaaaaataaattttatctcccaatgattagccttttggcaacagttactttcatgttttcctcttgtgataatgatgactccagtgatacgaccaaacctctgattgaacttcacgaaccggaagaaggtcaggctttggagataggaaacgaacatggggttcattttgaaatggatttgtcggatgatgtcatgctgaaatcctataagattgaaattcatagtaatttcgaccaccattcacacggaggtaatagcagggctgcacaggaaacagtagattttagtttcaacagatcctacgatgtgtccggacagaaaaccgcccatattcatcatcacgatattgtaataccggccaatgctactgcaggagattatcatttgatggtttattgcacggatgccgcaggtaacgaatcttatatcgcacgcaatatcaaattaagtaatgaggtggaagacgaaggccatcaccatgatgaataagacaatacatagagaaagaatgaggtgaggtcaaaaagggacgtttgacacattcccattctgtttttttacgtaatgagtattttttctttcgaaaggtgtaatagatattacaccttttttgtttccaatcctttacttttgtgaaaaatactttttcgtatgatgaagtttccaataataaatcgactctttccttcttataaatggaaggtagcggctgtcatcattggcggtgttattgtgggtggaggagcactgtttatgtatatgctccgggcgcatacctatcttggagatgacccggctgcatgcgtgaattgtcacatcatgactccttactatgcaacctggttccatagttcacatgcccggaatgccacctgcaatgattgtcatgtgccgcatgaaaatgctgtgaagaaatggacctttaaaggtatggacggtatgaagcacgtggctgcatttcttaccaaaagcgagccgcaggtcattcaggctcatgaagccagttccgaagtgattatgaataattgcatccgctgtcatacacaactcaatacagaatttgtgaagacggggaagattgattatatgatgtcacaggtaggagaggggaaggcttgctgggattgccatcgtgatgttcctcatggtggaaagaattccctgtccggtactccgggagcgattgttcctcttccggaatcgcctgttcccgaatggctccggaagatggtgaatcagaaagataaataagaaatgaaatacgtaataaaataataaaaccgatatacaatggaaaagaaattaaaatcatggcaaggatggctgttgttcggaggttcaatggtcgttgtatttgttttgggattatgcgtttctgcgttgatggaacggagggcggaagttgccagcattttcaataaccgtaaaaacgttatcaaagggattaaagcacgaaatgaactgtttaagaatgactttccccgtgaataccagacttggacggagactgcaaagactgactttgagagtgaatttaatggaaatattgctgtagatgctttggaaaaacgtcctgaaatggtgattctatgggcgggatatgctttctcaaaagattattccactccacggggacacatgcatgccattgaggatattacggcatctttgcgtaccggttcgcccatgagcccgactgaaggtcctcaaccgtctacctgctggacttgtaagagtccggatgttccccgtatgatggaggcattgggtgtcgattctttctataacaataaatggggggctatgggcgccgaaattgtgaatcctatcggatgctccgattgtcatgatcccgaaacaatgaatcttcatatcagtcgtcccgctttgatagaggctttccaacgtcagggtaaagacatcactaaagctactccgcaggagatgcgttcattggtatgtgcacaatgtcatgtggaatattatttcaaaggggatggtaagtatctgactttcccctgggacaaaggttttacggtagaagatatggaggcttattatgatgaggccggtttctatgattatattcataaattgagccgtactccgattctgaaagcgcagcatcctgactatgagatttgtcagatgggtatccacggacagagaggggtttcttgtgccgattgtcacatgccgtataagagtgaaggtggtgtgaaattcagtgatcaccatatccaaagcccgttggctatgattgaccgcacctgtcaggtttgtcaccgcgaaagtgaagagactttacgtaataatgtgtacgaacgccaacgtaaagcgaatgaaatccgtaaccgtctggaacaggaattggcaaaagcacatatcgaagctaaatttgcctgggacaagggtgctacagaaacacagatgaaagatgtgctcgcactgattcgtcaggcacaatggcgttgggatttcggagtagcttcacacggaggttctttccacgcaccgcaggaaattcagagaattctttctcatggattggatcgtgccatgcaagcccgtctggctgtatccaaagtattggcaaagaatggatatacgggagatgttccgatgccggacatttcaacaaaggcaaaagcacaggaatatatcggcttggatatggatgctgaaagagcggctaaggagaaattcctgaaaacaactgttccggcatggttggagaaagcgaaagaaaacggccgtctggcacagaaataagagaatttatatatgtggagctataaagaagggctggtgattggcgcaggattactggtgatagggctattgctgcaaatgacagtgggagccatacattgggacctgtttgcctgtccggtcaatgtgattgtgttagtggtttatatcattgctttggtagccatgcaccttcttcgcaaacgtgtctatttattcggatggttgagtcattattccgctgctgtctcgtctctattgtgggtggtcggcatgacggtagtgatgggactgatccggcaggctccttccggtcatgctccggctgatctgctgggattttcgcagatgatttcttcctggccttttgtcctgctctacttttggatggtcaccgccttggggctgacaatccttcgcaccggtttctctttgaagatcagcaggatttctttcctactgaatcatatcggattgtttattgcactgataacagccactttgggaaatgccgatatgcaaaggttgaaaatgacaacccggatgggaagtgccgaatggcgggctacggatgataaaggtcaactgattgaacttccgctggctatcgaactgaaggatttcactatcgacgaatatcctccgaaactgatgttgattgataatgaaaccggccgtacgcttcccgaaaaatctcctgtacatgtattgttggaagagggagtgacaaatggcagcttgcaggactggcagctaactattgagcaatctattccgatggctgcttctgtggctaccgaagatactttgaagtttactgaatttcattcgatgggagcgacttatgctgtctatctgaaagcagtcaatcagaagaatcaaacaaccaaagagggatgggtaagttgcggtagttttctttttccctataaggcaatccggctggattctttaaccagtattgtaatgccggaacgggaaccgcagcgatttgtatcggaagtgaagatttacacacaagaaggaacgatcacgggaggaaccattgaagtgaaccgcccgatggagatagaaggttggaaaatttatcaacttagttacgatgaaacaaagggacgatggagcgatatcagtgtcttcgagttggttcgcgatccgtggttgccggttgtttacacaggaataataatgatgatggcaggagccatctgtctgtttgtcagcgcacaaaagaggaaagaggaggacaaagcatgagttgggaatactttatactatttgcaatagccgcactggtttgttgggctttgggagcttttgctgcctggaaaggtacaaaaacgggatgggcttatggatttactttcttaggtctggctattttcttcagtttcattatcggaatgtggatttcattagaacgtcctccgatgcggacaatgggagagacacggctgtggtattctttcttccttccgttggcgggattgataacctatgcacgctggaagtataaatggattttaagtttcagttgtatcctttcattggtctttatttgtatcaatatcttcaaaccggagattcataataagacgttaatgcctgctttgcaaagcccgtggtttgcccctcatgtcattgtgtatatgtttgcttatgctatgttgggagcggcgacggtgatggccgtctatctgctttggttcaaaaagaaggagattgaacggaaagaaatggatttgtgtgacaacctcacctatgtaggtctggcatttatgacattaggtatgcttaccggagctatctgggcaaaagaagcctggggacattactgggcttgggacccgaaagagacttgggcggcagctacctggttcgcttatctggtgtatatccatttcagattgggcaagccattgaaggcacgtcctgcgttgattattctgttagtatcatttgtcctgttgcaaatgtgctggtatggaatcaattaccttccggccgcgcaaggagtcagtgtgcatacttataatttaaattgaaatatcgaatcacttaaacttcaatatcaatgaaaacactttattggtcattcttgcttatgctattgccaagcatggcatatacacaaaacacggagaaagagaatgaatttacgatgtctatgcaaatcagacctcgtgcggagtatcggaatggtgcattgactccacgggatgaaggggtagctcctacatctttcatcaataaccgtgcacgcctctcgatggattataaacgttcggatctggaactaaagatgtcggcacagcatgtcggtgtttggggacaagacccgcagattgagaagaatgggcgttttatgttgaatgaggcttgggcgaaactgaactttggtgaagggttctttgctcaactgggacgtcagtcattgatttatgatgatgaacgtattttgggaggactggattggaatgtagcgggccgttaccacgatgcattgaagctgggatatgccaacaaaaataatgaagtccatctgattcttgcttttaaccagaataatgacaatagaacaagtggaggtacttactatgattcttctaccggacagccttataagaatatgcaaaccgtctggtatcattataaagcggataatgttccgttcggagcttctttattgtttatgaatctgggattggaaacgggtgataaagccacggatgattctcatacccgctatttacaaacaatgggtacttacctcacttataagaatagtaactggaatctggatggtgctttctactatcagatgggtaagaataaagctgcggagaaagtttcagctttgatgggtagcatacaagccgcctatacgtttaatcagacatggggagccgtggctagttttgattatttaagcggtgataaaggaaatggcggtaagtataaggcttttgatcctctttatgggacccatcataaattctatggagcaatggattatttttatgcttctacatttgcaaacggttatgcaccgggattgatggatgctcgtatcggaggtcgtttccgtctatctggcaaggtagatatggaacttaattaccattattttagtacagcagttaaagttcaggatttaaagaaatcattaggttcggaagttgattatcagattaactggtcgatcatgaaagatgtgaaactctctgccggatattcttttatgcgtggtacgaagacgatggacgctgtgaaaaccggcaatcataaaagctggcaggattggggatgggtatcgttgaatatcaatccgaaagtatttttcactaaatggtagagaaataaacagaatgatgagaatcccggttgacttatgttgaccgggattttaggactttgatctctataccgaatatctgcttttagccgaggtaaatccctgttgacttaaggcatccgcaactcctttgtaatgaaacggatgtcggtagaaatcagctgccaggtctgtccagttgcctacacgattattccatggacgttctttaagataatgggcgtagataacgtcatattcagcgagtttatcttttaaatcagtcttatatgtctcttcgaaaaagacagcctgttgtggaaaacgaggctttaatcccggttcttctgcggggtagccgatacataatcccaacataggaaagacatattccggaagttgcaattcatggacaatttccagcgcatttttacgtacatctccaatagggactgttcccaatcccaatgattcggcagccacgacagccgcttcgagagcgataccgacttcatgagctcccacgagcaatgtgtcaatgtcctgcattacttcatcgagcgtttgctctttcttatggcaggcaagagccaccctatggtaatcagtacagaacacgaggaatacgggagcttcggcaatgtgtacctgatttccgcataattcggctaaacgtcttctatggtcggtattctttactgcaattatggaaacgagttgcaggtttacccagttcggtgcggcttgtacggcacggatgatggagtttaaatcttcatcacttaccgttctgtcggtgtatgaacggatggaacgatgtgccagcatactatctatgactttattcatttttcttattatagttcataatttatagcatttcatgttattaccaacctgccaatggtattttccgtgccggtgcgggaaacgcggtatccaaatcatgcaaatcttcctctgtcagatgaatggaaaggcttcggaaattatcttccacatgggttacattaccggctttgggtatggcaatgataccgggctgacgcatcgtccacgacaatgcgatttgtgcaggcgatacatcgtgtcgccgggcgatttccaccaatgtagggtggcgcagaagtcgtccttctccgatcggcgaataggccataagcggcattctacgggcagcgcaccacggcatgaggtcgaactctatgccccggtcgccgaggttatagagtacctgatcggtggcgcagccgcttccaccggacagtgaaacaatacgttccatgtcggctgtgtccatattactgacaccccataaacggatttttccctcttgttgcaattcggtcatcgcccgaacggtttcttcataaggatggcgtcctttccagtgcaacaggtagaggtcgatatactccgttccgagcttcagcaaacttcgttcacaggcgagtttcgttccacgatagcttgcattactcggtaaaactttgctcacgagaagcactttctctctacagtcgcggacagcttcgcctaccagttcctcgttgtcgtacatctcggcagtatcgacaaggttcattcccagctcgatgccatgttgtaatgcccgtatttcttcatgccgccgtgcggcggattgtcccattttccatgtgccttgtcccaacggacaaacagtttgtccattcgggaaagtgattattggtcgttctgttttcttcatattgtcactgccattatgtgtttattgcggctcattaagctattcctgataataatgcttgccactccgacaagcaggaatgccacagctcccaacggagatgattgtgttccccatacggttatgaacatgccacatattgccgctcccaacgctgttccgagatttgcggcggtcaggaacaatccgttggcaaaatcgggtgcttcggttgccgacgtagataccatgaattgattcccgttatttgcaatacctgcgaatattcccaatatcagaatgacgattgacgttggtatggtcagtttccctagtccgtaaagtacgagataaagtatcgccatgatggcaggtacgtatttcaacgtggcgaaaggacgttgtgccaacaactttccggctgcgatatttccgacgatatttgccatgccgtaaacaaacagcagaaggctgattaccttgaaggagacatctgtaaccgttatcaggtaatcggacaagtagctgtaaaatccgaacatggctgcattcatcagtaatgccgcaaggaaggagttccacaatacgggctttctcaatacgctgagttgtgtgccatacgataaccgttccttaacgggcatggacggtatgaggaaaatagtggcgagcagtacaaatgcattgacaacggtaaaaaataccattgctgcagagaatgaaaattcactggcgatgtagctcgtcacgggcactccgagcaccattcctgccgatactccggcaaagattttggaaacggctttcggagcatcctcccgactaacggaagaggctgcggttgagaaagcgatggatacatagagcggatgaaagaatgccggaatcgcacgggttatcaacagtacggtaaagttcgtcgtgaagaccgaaacgaggttggaaatcacgaacacggacaaggcgagcaccatgaccgttttacggtttacccgtgaaaaaagtaacggtacgacgggagcagagaaggcaatgatcagcgcaaagaggctgaccgtccaacccgcatccggcaccgtaacaccgaaggtttcggcaatgatagggatgatgcccactactcccatttcagtattcaatattccgaatactccgagtgtgaggatgaacatcaacaagtggttatgcttatttttagttgatatactcatgtttttattttatttgaggtttgacttgaaaaatgcttccagtttgtcaaacggaatcttccggtcgtaaaggtcggtgtggttggctccgggaacgattagtaactccttgttgttgcccttgaggcgtttgaaggcatcctcgctgaaataacgcgaatgggcattttcgccgtgaatgagcaatacagcattgtcaatctcgtggatataggttaacaatggcatattgatgaacgaaagagccatcgtggggttccatgcaccattagaattgatggcacgggcgtgaaaagcacgttcagtcttgtaataatcgaagtagtctttgacgaattgcggctcgtcgcccttgatgctagtgggcagaccgggcgtaccgggagtggccgtgccgttctgtgcatcacgggtccggatagcattcatcgcctcgcgtttgttgcggcgtacttcggcactgtcctcggcatcgaaatagccgttggcattcacgcggctcatatcgtacattgtagaagctactgttgctttgatgcgcgtgtccattgccgcggcattcagtcccataccaccgaatccgcagatgccgatgataccgatgcgtttggcatctacattggggtgtgcaatcaggaaatccactgccgcgctaaaatcttcggtgttgatgtcgggcgatgccacattacggggttcgccaccgctctcgcccgtataagaggggtcgaacgcaagggtgaggaatccgcgttcggccattgtctgcgcataaagtcccgatgactgttccttcacagccccgaaagggccgctaacggcaatggcagggagtttactttcgatattcttgggttcgtacaagtcggcggcaagtgtgatgccatagcggtttttgaaagttactttacgatgattaaccttgtcgctctgtgggaactttttgtcccattcctgtgtaagattcaatgtgtccatatgattacttgtcttttgatttgtaataccgttcgtgcagccggtaagcaaccccatacttaacaaggctgcgatagctgcggatttaaaattcgctgttctcatcattctattatttaaatggttattgttctatttcatattgcaaaggtacggctataaaataagcggcacattattgtcgggctcaaaaggagttactcaaaagctcaactatctattttcttaaaagctccatgcaaatggcaggaaaagtagttctgaatttatgataatcaagtttggcggtggacaatatggcatcagcatacacattgctatgaagattgtatactctatattttccggtaaattatcagggctgcccttaccgtaaggttactgtaaggaacaagctgtaagttgatatttaagcctcactgcgatgtcgcagtgaggcttaaataatttaattaaaaaactcaatatattttgctccgatttacacgaatgtggcggtcggcggcataccgtactgttttttgaaggcggttgagaagtgagacgggttcttgaaaccgacttcggcataaacatccacgacctttttgccgccctctttcatcagggcgtaagctacttcgagtcgtttacggataagccatttttcgggagtgaggtcgctgattttcttgaaatcccgtttgaatgtggcaaggctgcgtcccgtgtagtgtgccatctcttccatcgtgagctcgtacatgtagttctcgttcataaattccagaatatctattttccacggttcattgaagtcgaaaagcgtcggcgcgaactttttgtcgatatgtaataatgcgagcagaccttcctgcaatttcagttgcatcaggtcatccgcaggtttcaccttcggatcgaagtagggcgtcatcgaagcgaacaggctggcgagttcggccgttttcggaagttttatcactccggaattgagtttcgcggtattggtcggtactttacgttgttccaacttaccgtacatttcacgtaagaaacgacgtgtgaacatcaggaagataccgcagtagcgttcaccatctttcgtcttcttgtacatcgtaatgtgatggtcgcgcggtatgaagacgcattcgccttttccgacatgaatttgctcattgccattgtcgagaatcatctcacccgaatagacgtaattgatggcatattcgcgggagcgatgtacgcagccgctgaggtcatcatagaagaagctgtagaatacatcgttgtaattgaagataagcttcatttgccctaattgttcatctgtcatatttttttgcttttctttctgattgcaaatatagcaaaaacagttttatttctcttcggctcatttatatatttaacttgttttcgatataagagccaaattattccttagtttcaaccctgcccctgtttctttattatatgaatttctctaaagcggccttattcaaaatttccacccgtttcccttccatagtgataagcccttccttgataatcttattaatttctttcgataaggcgggacgtgatacattcaggtattcggcaagttgggattgcgtatgtgtaatctccactatcagggaatctttcttcttgtgctcgaacagataaacgataaatctttcccggacagtcttgcgggagagtggtttcagacgtgatacggtacagatattgcaattgcctgcaatgcagagaaaattgtgcaatacttgcgggtcctggctgataactttaaaggtagaatcctttgttgccataagtatcacactgtcctcaagggcagtgaaagtagccggcaatgtgttgtccgagctaaaaagatgtggagtggcaaaagtgcgtggcgcaatgatatattcaatcatcacttcatttcccagtccgtcgataatatccgtgcgcaatttcccttccaacaacacatacagtttgttgcaaggcgttccctgcgtaacaactatctctttcttgtttgctatatagactacgaaatctagtttctccaatagggattctttaatgtttaagggcaaattccggaaaagggggatttgaaacagcttttctttatgtgtgtcggtcagttgtatttttttcattgtatcatgttgttcgtattgtggacaaagatataaattaaatattggtagaaaaaatcttttgttatgtttgaatctgtaatctgggtatatttctctgtaatttatatacattcgctatgttataaattgtctatttttgcagagtaaaaagactgattaattctgaaagatgaaagtaataaaagaaagttatggctaaaaaagttttgataatttcgtccagtccacgtaaaggtggtaattcggatttgctttgtgatgaatttatgaaaggtgctattgaggcgggcaatgaagtagagaagatttttctgaaagacaaaacggttcatccttgtacgggatgcagtgtttgcagtatgtacggtaaaccttgtccgcagaaggatgatgcagcggaaatcgtggagaagatgattgctgccgatgtgattgtaatggcaaccccggtctatttttacaccatgtgcgggcagatgaagataatgattgaccgctgttgcgcacgttatacggaaataaccaataaggaattttatttcattattgcggcagcagaaaacgataaagcaatgatggagcgtactatcgacggcttccgtggcttcctcgattgcttggaaggaccactggaaaaagggacggtctatggaatcggtgcatggaaagtaggagagattaaagatactccctacatgcaggaagcatataatatgggaaagatggtgtaactgtttgttttccatattaaagatattcataaagaatatgataaatggatttgttcgaatatttgagatatagttttgaacttaacttttaaaacctgacgggaaatctggaaaagacggttatgttttccagattttccgccgtctttttttataagaagaggggaaaaggtgagggtagtgagggaggatttctaacattcgtgtttttttttagagaaaatatagataggaaaaaataaaatataaaaataaaaggttgcaattcctccctcactaccctcacctttttcccctttttacgattacttaattgactggattgcttgttctgccacagaattattataattttgtggcagaactttttattttgtataattcgtttgataactaactaagtgtcatgggctataaaataacgactcttgtggagaattgtgtctatggacgtaaattgcaggcagagcatggtctttctctttatattgagacatcgggacatcggttacttttcgatacgggagcatccgacttgtttatccgtaacgcccgcttgttgcatattgacttgcaaaaagtcgattatttgatattatctcatggtcatagcgatcatacgggcggactacgttattttttggaattgaatacgcaggcaaccgttgtctgtaagcgtgagattttttctcctaaattcaaggatgaacgtgagaacgggatgatgcatacacaaaatctcgatcgttcccgtttccgctttattacaaagcagatcgaactgcttcccggagttttcctttttccctctattgatattataaatcaggcagatacccattttgaacgttttttggttcagcaagaagatggatgcaaaataccggatacttttcaggatgaattggcggtggtattggtggaaccggaaggattttccgtattaagtgcctgttctcatcggggaataaccaatattttgcgtacggttcaggctgcctttcccgaatctccttgtaagttacttttgggaggttttcatatccataatgcggaaaaacaaaaatatcaggtcattgcagattatttacaggaatatcttccccgacagattggcgtttgtcattgtacgggagtggataaatatgccttcttttacaaggactttggtgacagcacattttataattacacgggaaaactaattcaaaccgatttatcggaataaatttataataatttgatatgaagaaactaataacttctttagcgctggtactatcagcattatccagctatgcaattactcctttgtggatgcgtgatgcacgtatatcaccggatggatcagaaattgttttttgttacaagggtgacatttataaagtccctgcacaaggaggaacagctgttcaactcaccacacaaacctcttatgaagccaatccggtttggtcgcccgatggcaagcaaattgcgtttgccagtgaccggaatggaaattttgacttattcattatgcctgctgacggaggtgccgcccggcgattgacctatcattctgcatcagaaataccgtcggcttttactccggatggaaagtatgtctttttctctgcttctatacaggatccggcaagcactgccctgtttcctacaggagcgatgacggaattatataaagttcctgttgccggcggacgtaccgagcaagtgctgggcactcctgccgaactggtctgttttgataaaacagggaagaactttctttatcaggatcgtaaagggtttgaagatgaatggagaaagcatcatacttcttccattacgagagatatctggttatataacacccaaacgggaaaacatacgaacctgacaaaccggggaggagaggaccgtaatcctgtgtatgcacctgatggtaatgctgtctattttttaagtgagcgtgatggaggttccttcaatgtgtatactttctctttgaataccccacaggaagtgaaagctgtgactactttcaaaactcacccggtacgttttttgtctgtcagcgataaaggtaccttatgttatacctatgatggtgagttatacacacagaagtctggtgcacgtccggaaaaagtaaaagtagaactggtccgtgatgatgagcagcagcttgctacacttaaattctcacagggagcaacttccgcttctgtatctccggacggtaaacaagtggcttttattgtacgtggtgatgtgtttgtgacctcaactgattatgctacaaccaagcaaatcacaaatactccggcaaaagaagctgccgtttcttttgctccggacaaccggacactggtttatgccagcgagcgaaccggtaactggcaactttataccgccaaaataagtcgtaaggaagacccgaatttccctaatgccactcttattgaagaggaagtattattaccgtctaaaacggtagaacgtacttatccgcaatattcaccggacggtaaagaattggcttttatcgaagaccgtaatcgtttgatggtactcaatttgaaaacaaaaaaggtacgtcaggtaacggatggttctacatggtataacaccggaggtggattcgattacgaatggtcgcctgacggtaaatggttcactcttgaatttataggcaaccgccacgatccttattcggatgtaggcattgtcagcgcacagggaggtgcaattactaatctgacaaatagtggatatatcagtggtgctccgcgttgggtactcgatgggaatgctattcttttccaaaccgagcgctatggtatgcgtgcgcacgcttcctggggatcgcagcaagatgtgatgttggtgtttctcaatcaggatgcttatgatcgttaccgtttgagtaaggaagatttcgaattactcaaggaatttgaaaaggaacagaagaaggcaaaggagaaagacgatgagaagacgaaagacggaaagaagtctaaggcggaaaaagcagataaaggaaatgctaacaagggaaagactgataaaagcaaggccgacaaggaaaagagcaaagtagatagcagcaaagacagtaatcaggatgagtctgctgatgataaggcagatcaaaaagagatacttgtcgagctgaacggcattgaagaccgtatcgtacgtttgactcctaattcttccgacttgggtagtgccatactttcaaaagacggggaagatctttactatttctccgcgttcgaaggtggatatgacctttggaaaatgaatctccgtgaaaaagatacgaagcgtctgcacaaactcaataccggttgggcatcgttgatgttggacaaaaaaggagatatctttttgttgggaagccggattatgcaaaagatggatgccaagtcggatgcgttgaagtccatcagctatcaggctgaaatgaaaatggatttggctgccgaacgtgaaacgatgtttgaccatgtgtacaaacagcatcaaaaacgcttctacaatgtcaatatgcacggggttgactgggatgctatgactaatgcttatcgtaagttcttgcctcatattgataacaattatgactttgcagaattattgagtgagtggttgggtgagctgaatgtttcacataccggaggacgttattctcccaaaggaaaaggagatgtcacttctaatctcggactcttgttcgactggaattatcagggaaaaggaatgcagattgctgaaataatagaaaaaggtccgttcgatcattcacgtaccaaagtaaaggctggttgcatcattgaaaagattaatggagaagagataactctcgataatgacataacctgcttgctgaataataaagcagggaagaaaacattgatttcaatctacaatccacaaaataaagagcgttgggaagaagtggtgatgccggtcaccaacgggcaactgaatggattgttatacaaacgttgggtaaaacaacgtgcggcagatgttgaaaaatggtcgaaaggacgtttgggatatgttcatattcagtcgatgggagatgatagcttccgtactgtatactcggacattctgggaaaatataacaactgcgaaggcattgtgattgatacccgtttcaacggtggtggccgtctgcatgaagatattgaaatactgttcagtggtcagaagtatttcacacaagtagtgcgtggacgtgaagcctgtgatatgccgagccgtcgttggaacaaaccttccattatgttgcaatgtgaggccaactactcgaatgcacacggaactccgtgggtatataaacatcaaaagattggcaaacttgtcggtatgcctgttccgggtactatgacaagtgtgtcttgggaaactttacaagatccttcactggtctttggtattcctatcgtcggttatcgtttgcctgacggcagttatttggaaaatacccaattggaaccggatgtaaaggttgccaataatccggaaacagtagtcaaaggagaggatacccaactaaaggtggctgtggatgaacttctgaaagagatagatagtcagaagaagtaaatacgagtataattatatctaaaataaagagtcgcttctttgaaagaatcaatcagattctaacagagaagcgactttcttttatagtgattttcttatattgacctttttatatgactccttttataaggcgtttattttaaatagatatagggcttacttccagaccggcagtaatctatggagggtttttctagtcattatcttctgattcaggaagctgacgatataccccgttatacaagcggcaatgagtgatccttctcgtactccctgaataccttgagtcagcagcagcgagagaatcacggctaatgtaaccaaagtaatatcaaaataaactttgaactttccaaattccttgttataatggcgggatgcatatttcacaaatgcttctgcgctcatcatggctacttttggtttcagttcaagcactactccgatagactgcaccatgcatcctgtaagtaataaagcaatcgacataccataattagcgggatgcagttcgcttgtcagcatcatattgaaatcaatgaatgccgaaaagataaaagagaacggtagttgaagaagaatttcaataatatcttgtcgggttctattctttcggattaaccagaactgtcccaggataagcaccatgttgatgataaatgtgcaagtacccaacgataaaggactattcaggcttaatacataattgatgctcgatatgggagtagttcccaatgccgagcgtataatcaacacgatacctgccgctaaaaaatagagtccgataacaaacactaaatacctcttaaaaatctctttcatttccatgtctttttaacctctttctattgattcctttctcatgtattgaaaaggatatgcaaaggtcttgttttttactctgaaatagattatctaattccatacagtttttgtcatatccgaaacaaatcgtatttttacgtcataaaataaaggtgtaaatggtaaaatctcgtatatttgataatacacaattgttgaaggagcatcctgaacttcctcattataaagaggaggtagtctgtttccggagtgaatataaagatagaagttatccggcaaatgaatgttatttcaatcgggagctttatatgatattcgttcttgaaggccgttcggaaattctactgaatggagagtttattgcgatagaaccgaatatgttacttattcacggagcaaattatctcacggaacatctttattcaagccgggatattaaatttatcactctcgccctttccgaatctatgcggacggacgattcatatctgacacaaatcacggcaatcctgttggcaaccatgaggcggaataagcaatatacgattcagttgacagagtatgaagctcaaatcatccataaggagctggaagtattgatgcatctgatgaatattgaacatcatttccttttccggcgtatacaggcagcgtgcaattctctgtttttggatatagcagattttctttcccgaaagaccgttatcaaaaaagagatcagtcgtaaagaccacgttctgcaagaatttcatgcacttgttacccgtaatttcagggaagaacattttgtgagcttttatgcggataaactggctattagtgaacagtacctggtacgcattgtacgtcttggaacaggtaagactatcaatagccttattaatgaattgttagtaatggaagcgcgtactttattgagttctaccaaatttacggttggcgagattgctgctaaactggggtttagtgatgcagccggtttttgtaagttctttaaaagaaatgcgggacagaccccgttgaattatcggaaaggattattgatttgaacggaaaggattattgatttgaacggaaaggattgctgaactgaatggggaattactgaactgaatagtgaatataatgaatttaaataataagttggctgatttgaatgaaaatggaagtaggttgatgcaactcaactgtccttaaagaccgtatacatcaacctacctgaatatatagtgaatgggtttgattttaaccgatcactgctgtgatatcttctacaatctgttcatccgtcagatgattggcacggagaaactcctgtatatcatatcggtcaacaaattcttttttagctccaaagttcagaactttcatgtttgtagcaccataataacgggcaatcttttcaccgaaaccgccatccaatacaccgtcttccaacgtaatcactaattcgtgatctgctttcagttcatccatcagttcgttgtctacaccggtgatgtaacgcggattgatgagtgttgcgtcaatattggctttttctttcagaagtgatgcaaccgactgtcccaatccatagaacgaacctaaagcaagaatggctacttttgatccacgatgcgtcactttatagcgattgagaacactataatcagtctccaccggttccccacaagtaattacatctgttgccggtacacggatagcaaccgggtattcattttggcggatactccattctagcatagcaagatattcctctttgcaagtcggtgccagataaaccatattaggaatattgctgatgagcggaatatcgaagaagcagaggtgagttacatcattcattccggacagtgttccccagaataccaacaaaacagccgggttattattgatacagaggtcttgcgaaagttgatcgtatgaacgttggataaatgtactatacactccgtaaacaggttttccgccattggctgcgatacccgaagcaagagctactgcgtgttcttctgcaatgccgacatctacaaactgtttgccagcttccttgcggcggtccggagtgaatccgagaacggcaggagtacccgaagtgattgtcaccacacgagaatcttcttccatctttttcagcagatattgagcggttacttcgctgtaatcttcttcctcataattgacttttgcttctccggtttccggattgaatggagtgcgccagtgataagtctctttatcctgttcggcacgttcataacctttacctttcaaagtgttgatgtgtactactatcggatgctgaatatctttcactttggagaatgcttcaatcaacgcctgtacatcgttaccgtcatttacatatatataatccagacccatagccttgaagaagttacattcgcactgaccgttgctgtcacgcaattctttcaggttcttatatagtccaccgtgattttcggcaatagacatctgattgtcattgacaataataatcatgttagtaccaagctctgctacataatccaatccttcgaaagcttcacctccgcttaaagaaccatcccctatgacggctatgatattttcattgccgcctgtaaggtcacgtccctttgccaatccgctggccagactgacagaagtggaagtatgtccaatgatgaagaagtcatgttcactttcttgcggttcggtataacctgatacgttgtcgtatttttccggatgaaggaacgcatctttacgaccggtcagcatcttgtgtacataactctggtgcgatacgtcaaatacaattttgtctttgggcgaattgaatacataatgtaaagcaatcgttgcttccaccattccgaaattaggtccgaaatgcccgccatgctcacttaatttttgcaggagtgctgcacggatttctccacctaattcgtttagctctttttccgacagtttcttaacatctgcaggagaataaatattttctaaatacatatcaaacagtttttctaaataatgtttttacttatttctttatgacactgcaaagatacagcaggatttgaaatctgtttgtatatgaattacggattgttttacctatattacagttcccttatttgagggactatatttttatgctaaagcctgatttctgtattcattaggcgtgcatccgacgcgtcttttgaataatctgcagagatgttgcgggtattggaatcctaacgaataagctatctggctgacggtttcttccgtatcgacaatacgttctttggctagttcgattactttggtctgaatatgttcctgtggagtttttcctgtttctttttttaccatatcaccaaagtagttgggggagagatagactttatcagcaaagtacttcacggaaggtaacccgttttgtatgggaagttgatcttggaaatattcatccagaagttgttcaaactttgtaagagcatctttattggcactgttccgggtgataaactgccgttcataaaaacgcatacagtagttcagtaacagttcgatattcatggcgattaatgctttgctatgtttatcgataccatgctcaagttcgatactgattttcttcaggcaatccatgactatttccttttcctgatctgaaagatgtaaagcctcgtttactgcataagagaagaaagtatatttcttaatatcttttccaagtgaggtgccgcgaatcaggtccggatggaaaataataccataaacagccggattgatttcatcttcaatggtactcacaccggctgtctgacctggggcaaaacagacaatggttccttcttggtaatcataatactgacgaccatatttaatgtcacagctcttgctctcttttaggaaaagagcataaagaccatagttcatctggatatggttaactgttttcgttgctttggtcaagtcgatgacactaaccaaaggatgcaatgtttccagtccgtacagttcgttatactgatttacattctctagttttataactttatccatggcttttggtatttggaatcggtaacaaagatacagataaatgttctgttttcatagtagggaaatgactaatctgtaattggggttatcatacccgtaatccgtctacaacggcttctttatattcttctgacctttgccatgttaaataaaacttgatgaatcagaggaaattaataaaagagagaatatggatagaaagcattttttgaaaagcgtgttactaacaaccggaggcgtactattaggtggtacgactatttatcggtgtttgaatagtaaagaaacgacagacacttcacttccttcgctaatcgataaaacacatcagggaaatatgaaaaagatacttgtaataatgagtgcaggcacaaaacgcggcaatacagaccgactgaccgatgcatacattaaaggattggtagagcgcggacattctgtgacgaaggtttatctgggtagtatgcggatagaagggtgccggggatgtggagtttgtcagcgtcttgcacatcagtgtactgttcgcgacgacatgcaggatatatatcctttgtttgcggaatgtgatacagtggttatggcttctcctctttacttttggacaatcacggcaaagctgaaatcgttcattgatagactttatgccatttctgtcgatgataaatatcctcaaaaagattcggtattactgatgacagccggtgatgataatgatacgaccttcgaacagcccatacgatattttcgtcttctcaatcaggcgttaggttggaatgaagtgggattatattgtgccggcggttctaccggatgcgagaaactggcacggcagattgataaagtacatcttgaaaacgcctataaaatgggattggaattataaatagcatatagtaactatggaacaaaaaaataaattaaaactcaattcgggcggtttgctcgtctttatccttacggtcggtgtatttggaattataaacaccgaaatgggagtagtggggatcctgcccttgatagccacaacttttaatgtttccgtacctcaagccggctggacggtaagtgttttcgcattggtggtggctgcgtcagcccctgtgactcctttattattttcggggattaaccggaagaaagtaatgttgctggcattgggattgtttacaataagtaatgtaatatccatgtttacctctaatttcacagtattgttgattgctcggatacttcccgctttcctgcatccggtatatgtctctatggcttttacagtagccgcggcgtctgtcagcaaggaacaggctcccaaggctgtttctaaagtctttgtcggtgtgtccgccggcatggtgctgggcgttccggtgactagttttattgccagcgaagtttcgttctccatggcgatgttgtttttcactgttgcaaacgcattagtctttgttgctacgattctgtttatcccttccatgcctgtaaaagaaaaagtatcttatggtgcacagcttagcgtattgaagaaaacaacgatgtggtattcaattattgctgttaccttaattaatggagctatgttcggattctttagctatatgtcggattacctgaaaaaagtaacggaggtcccatataatgtgataagtgcagtgttgctcgtatatggtttggcaaatattgtgggtaatgtgatggcggggaaactgctatcaataaatgccaaacgttcaattatccttatgccttttgcattattggtttcatatatctgtctgttcatcgttggagaatggattggagctatggtgattgtcatccttattttaggcgtattggcgggtatagcaagtaataatatgcaatatatgatagcagatgctgctcccgaagcaccagactttgccaatggaatgtttctgacttcagccaatttaggaacgacgattggtacagctatatgcggagcttttattacagagatgggcacacgatattctgttttcggctcgttgtttttcctgattgcgagtattgtattcgtttatctgcgggttcgcgtagcgcatatccggaagcaggttaatatcaatattgtaacagaataataaaaaaatataatctgtaattggggttattatgtcagtaattcatctacaaaaggtctctttctttcatcgtatttttgcaatgtagaaagtagacaatcaattctttaataattaaaaataagagatatgaaacggattttattattaacaactgtatttatgatgatgcttggaactagtttttcttctgcacagacagatgcagataacttttataaaagtgatttggtaagtgtggagaaagtttctttttccaaccagtataaaatgaaggtagccggaaatttgtttctgcctaagaatatgaaagaaggggacaaataccctgcaatcattgtcggacatccaatgggagctgtcaaggaacagagcgcgaatctttacgcaacgaaaatggccgaacgggggtttgtaacactctccatagacctgtctttttggggtgggagtgaaggcgagccgcgcaatgctgttctgccggaagtttatgcggaagactttagtgccgcagttgattttttaggtacccgtccgtttgttgaccggaatctaattggagtaatcggtatttgcggtagtggaagttttgctatcagtgcagcgaaaatagaccctcgccttaaagccattgcgacaatcagtatgtacaatatgggtacggctagccgtaacgggttaaaacactcattgacattggaacagagaaagcaaataatggctgaagcggcagaacagcgttatgctgaatttttaggtggagaaactaaatatacaggtggcactgtacatcaactgacagaaaagtccagtccgattgaacgggagttctatgagttctaccgtacacaaagaggaaaatttacccccgacggagcaactcctatgaccaccactcatcctacactttcaagcaatgtgaaatttatgaatttctatcctttcgaagatattgagactatttcaccccgccctatgcttttcatcaccggtgaaaatgcccactcacgtgaatttagtgaagacgcctaccgattcgctgccgaacctaaagaactgtatatagtacccggtgccggacacgtagatctttacgatcgtgtgagccttattccatttaataaactggaatccttctttaaggaatatctaaagaaataagttttaatactataaatatgagatactatataatagcaattcttactatgctgacattatcggtcggttccgcatcatgtagcgaagatgaacctatacagggaacaggtcaacaagtgactccgggtaatggttctggttccggtgataatggcagtaacaataatggcaataatcccgatgataatgacgacaataacgatgataccccagtgagcaataatcttaaaataacaatcggacctgtttcattcaatgccacattggacaataatgagacagcgaaagcatttaagagactactccctatgacagtggatatgtccgaactgcatggtaatgaaaaatattattatctgtcgaaaggtttgccgacagcgtcgtccaatcccgggactattcggacaggtgacttgatgctttacggttccacttgtgtggtcttattttatgaaaccttttccacttcatatacttatacccgtttaggacgtataacaaatccttcaggactggcctccgcccttggttcaggaggcgtaaatgtaacttttgaaataacagattaaagaataaactaatggaacaaataagaaataaagaatatggaggcgaacgtcctctgttcgcgacccacgaccttcaactggaagatgtaacaattcacgccggtgaatctgcattgaaagaatgtagtaatattatagcaatcaactgtcgctttgaaggaaaatatcctttttggcataccaacggattcattgtgaaaaactgtctctttacagagggagcccgtgctgctctatggtactctcaaagtctgcaaatggcagataccttggtagaagcaccgaagatgttccgtgaaatggatggaataaaactcgaaaacgtgcagttgcctaatgctttggaaacgttttggtattgtcgtaatatagagctgaagaacgtacagattgataaagcggattacctttttatacacagtgagaatattaagatacaaaactatgcccaaaacgggaactattcgttccaatattgcaagaatgtagaaatccgtaatgcagttatcaactccaaagatgctttctggaatacggaaaatgtaacagtctatgattccgagctgaacggagaatatctgggctggcattctaaaaacttacgtttggtaaattgcaggatttcggggactcaaccgctttgctacgcacatgatctggtgatggaaaattgtacgatggcagaagatgctgaccttgcttttgaacacagtagtgtgaaggcaacgattaaaagtcccgttcatagcgtaaaaaatcctcgtacgggaagtattgttgccgaaagtttcggagcaatcattttggacgaaaatattaaatcaccagcaaattgcgaattgaaactttgggacgatctaacctgttttgattgaaatatgaaatataatttcgatgaaattattccacgcagaggtacgaattcctataaatgggattcgtccgcagatgcggatgtcttgccgatgtgggtggctgatatggatttccgtacagctccccccgtcgtggaggcattgaagaagcgggtggaacatggggttttcggatatgtacgcgtacctgacgcatactacgaagcgataaccaattggtttgcacgacgacatgcctggcggatagaaaaagaatggattatttatactaccggagttgtgccggcaatatctgctgcaattaaagcactgacagtacccggcgataaagtgatggtacagacgcctgtatataactgctttttctcctctatccgtaataacgggtgcgagatgattgccaatcctttagtatatagaaacagagggtatcagattgactttgatgatttggagaagaaaacttccgatccgaaggtaaaactcatgttgttatgtaatccgcataatcctgtcggaagagtatggagtaagcaggaattaaggcagataggtgagatttgtattcggaataatgtgtttgtgattgctgatgaaattcattgtgaattggtttttctggggcatgaatatactcctttcgcttctatatcagaagagtttcttatgaattcggtaacctttgtttcgcctagcaaggcttttaatctggcagggcttcagatagccaatattatttctgcagatgcaaatgtacgggtgagaatagataaagcgattaatataaatgaagtttgtgatgtgaatcctttcggagtggaggcgttgatggctgcttacaatgagggcgaagaatggctggaagaacttaaaatctatttgtttgcgaattacatctatttaaaaggttattttgatgaatatcttccggaatttcccgtaatgatgttggaaggtacatatctggtttgggtggattgctcggtcttgaatcaaacgtcagcagaaatagtaaaagacttgttgaagaaagaaaaactttgggtgaacgaaggcagtctgtatggagagactggtgaagggtttatccgtatcaatattgcgtgtccgcgacagcggttgatagaaggattaaacagattgaagcgggtactgaaatcataaatacgaatgaaaagaagtagttagaaaaaagaacgctcaaacggtaaatataacatactccgtttgagcgtttctcttattaagaaatctttttggaatgatgggggagaaaacgataagttatatcctccattattccattttctatgtggtacaaccgttgattggtcgtttcagattttaatcctcccagagactcgatgtaaggtcctaactttatatattggaaatgagatacatcaaagtgctccggcagcttgctcttcccggagtaccatccgacttttaccggagtgatggtctgcttgtgtaaaaaagcagctaattgttccacttctgcgggtgaagcatcaccgcccatgaaacagacacaggtaattgcttttccatatttaccgagcagggtagaaagactttcttccgtcaatggttctcctacgtcttccatcagatatgcactgtggcaccctttacaatggttggggcagttggagaggttgatggctaatgtcacctcatccggtatctcctgaaaaacaatatcataatcagcgtaccggagcataatatcttaaatcggcctccttttgccgtgcttgggagaaattgctgatacgcttcatatatccgatgacgcgggtcagataatccacattctcgctgtgacattcgggacattcatgcaaataccgtttgtcgatatgatggcatttgttacatactgtattcggaatattgaatgtgaagtagttgcaaccttcggtagcggcaacacgaagcaactgccggtattgctctttgctaagatgctcttccagattcatgtgcaaagccgaaccacccgtcagatgctcgatataacgatgcccgtgcaggcggaatttatcgacaatgttcagcgatttgtcttctacaatatagaaatagctgttgtaacattcgcggtaagtctggaatccggcttccttgtcccatttcgcgtgtttcacacccacattttcggcaggaatcatttcgcagttgaaaagtacttctttggtacgatatttcttattgtatttctcaatcatgccgagaatctcctgcacaaaagcctcgtatttcggattgtcgttgatgtcgattcccataaattgggctgcttccaccagtccgttcacgccgatagtcagatattggcggctcatattgatataacccgcatcaaacaaaggtaacataccctttgcctgcaataatttcaggttctcattataggcaagctgtactttgtgaactaggtctactacttcttccaggaagaaagggtagaggatacctgatttcacagcatgctgtatacaacggttcagattgatggtcaacacgctcttcgaaccggtagagactcctccggctcccagtgtataactaaagccattgtcctgtatttcattacgtagacggcagcagctactcaaagagtcggcattgtcactcatataggtgaagaatgaatgtccttcggcatacatttcagcggtgaagtcgccatattccttatccagtacatcgccgtctttggtcaggagtgccattgtctctacagggaatgtcagaacggtgcgtgtacgctccttattaaaccatttcataaaacgcttctgcaaccagctaagcgaatcccagtcgggtttgcttccgtcggggaaaacaaagtgctcgaaaaggctattgaaataatacttgtcataataagccacattccagaaaactgcttggaaattgcgggcacccgtaggctggttgatggaatatacgatttgctcgaaacagtctgtgatgattttatcgatcgatctttgtttcagagacaagtctgccagtttatccggatgtttataatagtcctgtccgtattccaaaccaatgaaatagttcatgtacatcaggaattcaggagtggcacatgcgccgcttagcatactggatacgataaataccatgttgataaatcctccgcagaaggatttcagattggtcggggcggtagaattgcctcctactgctgttgttcctgctatcagccagggatacatagtaatactggcacagtagttcgccagattggtttcatcatttttgtagatgaagtgatgattcaggagttccaaataacggtcggaagcctctttaccatacatatccctcaaacggtctgtcagcaggcggcggttgaggcggatgaaattggatttgggcagttctcctatcagcgtggcgatattcttgttttccacattggcgttggcatcgtacttgctaccgctggcagggttggaagcatcgcaataatccatgaggaatttaagtttgtctctgacttcacggtcttccaaatgtttttgacgatacagcatatacgctttggccacgctgtaataatgttctgccatcaaggcgacttccacctggttttggatttcctctacgtttgttccgtcactgatactgacacggcttaacacattggttatcacatcttgtgtagcaaaactacctactgataaaaatgccttggatatggcatttttgattttgtcgagggaaaaagcttcttttttcccgtctcttttgataatgaatatctccgaactaatcatacctatattttaagaattaacaaaatagatttagtgcctacatagttattcatgcacgacaatttctggagacttgtaataaaatggacctgtacgattcgttctattgcctttcacccgaaagcctggaataacggaaattttatcggcaggtcttctgacttgtttttgttgtggcgccttcccgatccgtttcatgaatcagtggcaaatgaatgccataacatttctcttttttatgagagagataaaacttacagctacggggatagttccggattttcactggattcccttttaattccgtctggtgataatgccattccggaaaccgatgttggcggcaaagttagaaattaaatcaagattccaattgaaaaggaagaaaaatattcgctctttatcagaacgatatatggcattaacaacctgataactttccgtttatgttctattcttcgcattttagtagagtccggtttatgtatttcctgcctgatggatgaatgaaagtgtagaataatgaaataagatgcataatggttagcgatgttgggatccctttctcttcagggaatgaggcgtttgcattgatgtttccatattttagatttttcgaaagcataatagatgttaatagggctcatggcttgcgaactaatttttgatatgatatgttgtttaaagtgaataacgaattaaaaaataaactagaaagttagacatgaacaaacaatacatttctaatgatttagcagataaaacattacatttaaaacttatgaatatgagaaaatctattattttattagcttttatattgggtggctttacagtagcaaatgcccaatcagttgtagaaggtaccaaacttacagataattggtctgtcggagtaaatgccggtggagttactccccttactcacagtgctttctttaaaggtatgcgtcccacttttggagtgggagtctcaaagcaattaactcctatcttcggtttgggattccaaggaatgggatatatcaataccacatccagtaaaacggctttcgatgcttcggatgtcagcgtattgggtaaagtcaatttgatgaatctatttgcaagttacactggcgaacctcgtttgtttgaagtggaagctgtggccggaatgggttggttacattattatgtgaatggcgatggcgatcagaactcctggtctacgcgtttgggattgaatttcaatttcaacttgggtgaaagtaaagcatggacattaggaatcaaacctgccattgtgtatgatatgcaaggtacttaccctgaaacaaagagccgtttcaatgctaataacgcaggttttgagttgacagccggattgacatatcactttaagacaagtaacggaacacatcattttgccaaagtgagagtatataatcaagccgaaattgacggactgaactcttcaatcaatgcacttcgtgcagatgtaaacaacaaagatggtgagatcagcaatgcaaaccaacgtatcaacggattgcaggaagaacttgaagcatgccgcacaaaagtggttccggtggagactgtagtgaaaaccgcccgtgtacctgaatctatcattactttcagacaaggtaaatcgtcagttgacgcttcacaacttcctaatgtggaacgtgtagcttcttacctgaagaaatatgctgattctaaagtggttattaagggatacgcttctccggaaggtagtgttgaagtgaatgccagaattgccgcagcacgtgcagaagctgtaaaaacgatcttggtcaacaagtataaaatcagtgcatctcgtatcactgctgaaggtcagggtgtaggcgatatgtttactgaaccggattggaaccgtgtaagtatatgtactattgaagattaaactgatatattacagaaatagaataatgaaggctgccccaaaaggcagcctttgttgcatatcttgggttgtatttttgaatactctgaaagtttagtaaacagatttctttgtacattacataaaatggttatttttgcaggtattgttcatgcgcgttctgtgttgagtgtgcaaatatcaaccattaaaaactgtattatgaagagagtattcgtttttcaagattttaaatcgcagaaattctggagcatagaggtagtcggaacagatgttactgtaaattatggtaagttggggaccgacggacaaacacaagtgaaaaactacgcaacgactgaagaagctgaaaaagcagccagcaaactgattgcggaaaagaccaaaaaagggtatgtagaaactgctgaagaaactgcacgtgaaatgaaagtggaagccaagaaatatactttgagttatgatgagtatgaaaacaatgtgaatcttctggataagatattgaaagataaacatctctctgaatataaacaaataacaatcggttgttgggattatgagggtggcgactgttctgccttattacagggaatgattgaaaataaggagaagttcgcacaaatagaaggcttgttctggggagatattgagcaggaagaacaggagatttcatggattgaacaagctgatattagtccgctgctcgatgccatgcctaaattgaaagatctgaaaatcaaaggaaccaataatctgcgtttgggaaagacttcacggccggagttgcggtcactcgaaattatcagtggtggcctgcctaccgaagtggtagaagatattcttggttctgatttccccaatctggaaaaactgattctatatgttggtgtggaagattatggatttgaagctgatattgagatattccgtccgttgttctccaaagaacgtttcccgaagctgacttatctggggatcgtcaactctgaagaacaggacaagattgtagaaatgttcctggagtcggatattcttccccaacttgaaacaatggatgtttcggctggtactctcaaagatgaaggtgcccaattattgctggataatatggataagatcgctcatttgaagtttatcaatatgcgctataattatttgagcaaggagatgaagaaacagttgcagagtctccctatgaaaatagatattgctgaaactgaagaggcagatgaatatgatggtgaattgtggtattacccgatgattacagaataggagatgcagataatcgttgtcagcaactctctgtccaaacgtatagaatactttattgaagcaggcaaacacttgcagacggaagttcgttttatgacttacggggaactttttaactgcttgccgcaactacggcaggcagttatcaaactggaaccttgtgtaagcgatgaaacgaatttcctgaaatatgcgctgttgaatcaggcatataaggagacactgcaacgtttaggcgagatgaggctatctgatgacgtgtgctttttgaatactccccatgctttattacgtgctcttgataaaaaggaaactaaacaagtgttgatggacagagggttgaaagtgactccgatgttaccttctccccgttcttttgatgagttgagagagcttcttgccgattgcggtagaggatgctttttgaaaccccgttacggttcgggggcgggaggtattatggctgttcgctatcaacccaaccggaataaatgggtagtctatactaccttacaacaagtggacggagtcattcataacaccaaacgtatccaccgtttgagtacggaaaaagagatgatcccgttggcggaagcggtgatgcaaacagaagctattttagaagaatggattcctaaagagcagttgcagggagagaattatgatctccgggtagtgtgccgggaatctgaaattgattatatcgttgtgagatgcagtaaaggaagcataaccaatctgcatctgaacaataaggcacattggtggaacgaattgtctttgccggaagtagtgcggcaacaaatctattttcagtgtcaggaagcggttcaatctttggatttgcaatatgccggagtggatgtactgatagagagaggaacagatattccttatataatagaagtcaacggacagggagatcatgtgtatcaggatatgtttgctcataattctatttatattcaacagataaaaaacataaaaaagagatataaccatgcaaatagatgaactgccggctggcgaacagacccaaaatccggatctggatatgaatcaggtggtgggtactcatgatatattgatgctttgctttgataccttgcgttatgatgtcagcaaggaggaagaagcggcgggaagaacaccggtactgaacagtcacggaggagaatgggaaaaaagacatgcaccgggaaattttacttacccgtctcattttgccatctttgcaggatttctgccttctccggcggaacctcattcgctacgcagccgtaagtggttgtttttccctgtgcaagctggtacgggacgtattccgcctgcgggaagttatccgtttacggaagcaacttttgtgcaaagccttgccaatgtaggttatgaaacgatttgtataggaggggtgaacttcttcagcaagcgtaatgaactggggcgtgtgtttcccggttactttactaaaagttattggctgccgacctttggatgcacggcacccgatagtactgaaaaacaaattgattttgcattgaagaaactcgaaaactatccggaggacaaacggatttttatgtatatcaatttttctgctattcattatccgaactgtcattatgtggaaggcaaaatgaaggatgataaggaatcacacgctgccgcgctgcaatatgtcgacagtcagctcccccgtttatttcaggcctttcagaaacggggaaatacgctggtgattgctctttccgatcatggcacttgctatggagaggatggatatgaatatcattgcatatctcacgagacggtttatacagtcccttacaaacactttattttaacgaaaaaatgaatcaaccgctaccacgatatgtagactatatgtatagttacccacataaaactgcttatcgttcttttccgtccccggtttcgctggttccttacctgaaacaggtggaaggacagaaagcatcgctttatttccatattcctttttgtagtcataaatgtggatattgcaacctgttttctctgcaaacaaatcgtgcggattatatcgcaacttatttggaaactcttcacaagcaggcgcaacagttgtctccactcactaccggactggcatttgatagtttcgccattggaggaggcacaccgttgctcctcactgttcctcaactggaatacttactggatacagctgccttattcggagtgcatccttcacatacctttacttccgtagaaacatcgccggaatatgccgatcctgcccgtttggacttattgaagcaagcaggagtggctcgtgtgagtattggcgtacagagtttccttgacgaagaattaactgctttgaaaagacgtccccggcgagacatgattaatcaggcgctggaggctatccggaagagacaattcccgttttttaatattgatttgatttacggaatcaaaggacaaactgtggccagctttctttattcattggaacaggctcttctgtttcagcctaacgaactctttatctatccgctatatgtgcgaccggaaacggctatcacggagcgggaatccgacgatgtctgttttcagatgtattgtgccgcttgtgatttgttgaaagacagaggttttctacaaacttcgatgcggcgttttattcatcatccgtctactgatgcggaaatctcatgtggggatgaagtgatgctgtcgtgtggctccggcggacgcagttacctgggtaatttgcattatgccacccggtatactgtttgccagcgttgtattgccggagagatagatgattatatgggcactactgattttacagtggctcgtaatggatttattctttcgcaggaagaacagcggcaacgttttatcattaaaaatctgatgtattatatggggcttgataaggccgaatatgagcgtcgttttggagaatcaccggataatgtgccgttgtttcgacagttagctgaacggcaatggatagaagatacggataacggtcgtatttgtctgacttccgacggaatggcatactccgattatattggtcagttgttcattactcctgaaataagagaactgatggaaacttattcttattgaacgaaatagaaatggaaaacgaaggctctttactttccttcaggcgtatatattatcgcggcaaattgaatagctgcaactatacctgttcttattgccctttcggcaagaagtcgcatctggcagatacgacacaggacgaacaggcatggaatcgttttatagcagctattgaacaatggaaaggggagccgttgcagttatttattattccttacggtgaagcattgatccatcgttattatcggaaaggaatgatgcacttggcagcattgccacaggtggctggaatttcctgtcagactaacctttcttttccggctaaacactggcttgatgagattcgtgtaactcccactgtgataagtaagataaggctttgggccagttttcatccggagatgacttcggtagagaaatttgcgcatcagattcatatactccatcatgcgggaatacaggtatgtgccggagcggtaggaaatccctctgcaaaggccgtactcaatgatttacggaatgctcttttaccggatatttatttattcattaatgctatgcaagggttaagggcaccattaagtcaggaagatattcagtttttcaggcaactggataatctttttgagtatgacttgaagaatgctccggtacaatgggaagtttgcgcaggaggaaggaataattgttttatcgattggaaaggggatatgtatgcttgtccccgaagccgggtgaagattggtaatttttatcaaggtgatggagctgttctgccgctatcttgcgagaggaaggtttgtgattgttatattgcgttcagtaacctgaacaatcaccctttacatcgaatcatgggagaaggggcgttctggcgaataccggacaagccacttattacgactgttttcttcgatgtggatggaactctgactgattcacagggaaaagtttctgaaagttatgctaacgctctacgatatatggcacagtccgtttccttatatcttgccacttctctgtcgatggagcaggcgaagaaaaagctgggaaaggctcttttctatttattcaggggaggagtttttgcagatggaggtttattatcttattcgggccagatcaggtgtttgccggtgaaagtatatccggaggtatatggagaatctgcaaaagtcactattcataattatgaaggagtggtttacaagtatagtatattggtacgtgataaagaacagagagaagctattcttatccggttgaaagagaatccctgccaggtttttcataaagctccgctgataacagtcattcatcctgaagcgagtaaaaaagagggggtaattcagttatgtaaggctttgagtttatcttttgaacacaccttagttgtaggaaattcgttaaaggactggccgatgatgtccgtagtttctcattcttgtgccgtaatgaatgcggaacccttattaaaagaacgcgcacgttatacgctgaatccggatcggttggcagctttctttcgtttttctaacggagatcctatagaccaaacctcgtctgataatagttgatatatagctagttacatcttcataagaaaataaaaaccggttaaaatttggtaattatgaaaacaaagcccatatttgcagccctgaaatagggacaggcataaaaatcctcatcggagggtgctataataataattatagtgctggataagatgaatggtgcaaatcattcgcttgtccggcactttttttatgttgtaacaaaataagataaagaggaaaagtatcgaagaaactatgaaagagttagatttgacacaaggaagcgtaccgaaggtattgttgcagtttgcagtaccttttctgattgccaatgtgctccaggcactttatggcggagctgaccttttcgttgtcggacaatatgatgattcggcaagtgtggcagccgtagctattggtagtcaggtgatgcagacaattacaggtattattctgggtattactactgggacaacagtgctgattgctattgctaccggagctaaagacaatcgaaaagtagcttttactatcgggtcttccgtatggttgttttcaataaccggcgtagtgctaactttagtcatggtgctttttcatagtcggatagcagaactgatgcatactcctgtcgaagcgatggtagatacgaaaaactatattttggtatgctctctgggtattctgtttatagtaggatataatgttgtatgtggtattttgcgtggattgggtgattctaaaacaccactttattttgttgggctggcatgtgtgataaatatagtgctcgattttatattggtcggttatttccattggggagctgcaggagcggctattgctactgtaagtgcacaaggagtcagctttggaatagcgctctggttcttataccggcacggattccattttgatttttcacggaaagatattcgattgaaccggaatctgtctaaaaagatcttggtgttgggagcacctattgctttgcaggatgctttaatcaatgtttcttttctgattatcactgtcattgtcaatcagatgggagtcattgcatctgcttccctgggtgttgttgagaaaatcatcgtgtttgctatgctgcctccgatggctatatcatcggctgtggcaaccatgactgcacagaactatggagcgggacttatcaagagaatgaataaatgtctggcttcagggattgggattgctcttgttttcggtgtgtcggtttgcgtgtattcgcaattcctgccggagactcttactgctttctttacgaaagatgctgctgtggtggcaatggcggcagattatttgcgagggtatagcatcgactgcatcgtggttagtttcgtgttctgcattaattcttatttcagcggacaaggaaactcgttattcccgatgattcacagtctgatagccactttcctgttccgtataccgttgtcatactggttcagccagatagatagctcgtcgctgtttatcatgggatttgctccacccatttcaacggtcgtttcattattgatctgtatctggtatttacgatatacccaaaggaaattatatttgagaggcacaatgatgcctgctatgtcgaattaggtgtttttaagtgacatatattaactaaaatctattttgtatggaagcttatttgaagaaactctgttttgagtatcaggtggatgaaagagaagtgaaagagctgttggctcgaatggaaatggtgtatctggataaaggagaaacgattgcttctgccacattgccagagcagagcttgtacattattgtttccggtattttgcatacatataccactcatgaaggagaagagagaaccaatcggtttttctctgcgggtgatgctgtgttatgctataattcaagtcagtattctatcaagacactgacgaaatgtgctgcttattacatcagtgaagaggagattgaagagttgtgtgcatcttcaatttcatttgcgaatctggtccgtcaactgatggagtatcagttttactttaaagaggaagaggatatgaatgcccgcaagctgacagtaagggaaaggtacctctctttattggcggaaattccggatattctgtacagggtgccattgaagcacattaatcattacttgggggcagatgtgaccagtttgggatatctggccggaagttctaaataggaaatataacctagacatatttttctatgtattccttatcagatggttcatggcttattcaatcgaatcgaatttgaaaagtctttggattatttggtaaggaatactatttttgtattctgaatgaaaaactcaatacctcgatatactttttataagcataagtatgggagtgaacttttggtcgatgtagtagaactgaagtatgtgaagaagttcctggctaaaagtgctgtccacactctaaattattatgatattacttttataacagaaggtaagggagctttttcagtcgataaccaaacctatgaagcaattccatgtgacgtccttttctctaaaccgggggaaatccggaactgggatactcatcatatcaccaatgggtatgctctgattttcgaagaagaatttttgtctttcctctttaaagattctttgtttgtacagcatctttcgttttttcagatagaaagttcttcatcgctactacatttgtctgatgagctttatacacgcatacttgaaaccttgcatgatataaagatggagattgattcgtatcaacagggcgatgtacacgttttgagagcattgctttatgaagtcctgatgttgctggaccgtgcttaccttaaaatgacttcgatagaggagggcagaagtagggaagtttccaataatcatgtaagtaaattcatgaatttggttgctacacatgcaaaagagcaacattcggttcaatattatgcggataagctctgcattactcctaattatctgaatgagatgataacctcgaccatgggaatcagcgcaaaacaatatattcagagcaaggtgatggaagaggctaagaggctgcttgtttatacggactttcctatagctgatattgcatttgaactctgtttttcaacggtttcttattttatccgtagcttccggcagcatacgggagaaactccgttattgtatcgtaaagcacacaaaccgtaaaaagtgctatttctacctttctttttattgcattgctttcctggcatttctctactttcgcatcagataataaaccaataataaaaagtaaaatgatgagagacgcggaaaaaacagtaggcaacatgattgataagctgaaaacagcttttatcggttcgatagacggtgaaggatttcctaccatcaaagcaatgttgcaacccagaaaaagaaaggggataaaaacgatttatctgacaacaaatacgtcgtccatgcgtgtggcgcaataccgtgagaacaaccatgcgtgtatctacttctgtgatacgagattctttagaggtgtcatgctacgcggtacgatggatgtcttgacggatagtgccagtaaagagatgatctggcaggagggagataccatgtattatccggagggaatggcggatcccgattactgtgtattgaagtttactgctatttcaggacgtttctatagtaattttaaatcggaagattttgtggtcgaataaggtgcaagatggggtgatttgaatggtaataacggagtgtgtcaaaacgcagattaacgcaaattatcgcagaaataattttataaatcgttgattaatatatcaatataattggaataatctgcgataatttgcgttaatctgcgttttattattcattatgacacacctccttatatagtatctatactattcctcataacacaataagttctgcaattggttgatgatgttttgtttccattcttgcaggaagtcagcaaaagcggcttcatcttccaagaataaagatactatcaggttcttggcaagaaatggatagctcaataggctgtagacagtcagaaatacaatatgtatcggaacctttttaagtttaccgtcttccattgctgtcagtatactgtctttcacttgggataaagcatctccgaactgaagttcttttgcagtggcaagcaagtggtttacatcacgctgtatttccccacaaatgaatctgggaagacagggattacttgtgaaaagctcaatatactcatccagaatcatgcttagtcgctccataaatgggatatcctgttttactatatcctgtattttcggcattaaagacatgactatcgagccgaacacggctttgaacatcttatctttggttctgaaataataatgtaaagtgggccggttgattcctaccgttgcagcaatatcactcatgctggtctccacaaatcctttttctataaaaagttgttgggcagtttttattatttgctgctctaaatcgctatgttccgttgtagccataattttagttgtttatgttgtcaataaaaagtaataatctgtttgttatgttcacatcgctgacgctactgtcaaagtctaaagatagtatattcatttgagggcacagcgattttatacgtttttctattcctttttctacaatgtgattggcaatgcatccgaaaggttgcaagctaatgacatgattgactccttgggaagcaaaggatagtatttcaccggatatcagccaaccctctccaaactgggtgcccaaggagatgacttgtttagctttttctgccttttcaaagatagattcgaacggtatgaagtaattgaaacttttgccgatttcattcaccttattaatttgtttctggactttcttgtataaccagtctataacaaagtcgggagtgagttttcgctgcaagtgttggttctgtctcactttcaggttgacaaatccctgcatgaagaaatcacttatcagtggcggaatcacttcgatcttctggttgatgagccatgaggtgacgtccttttgagcaaaagggttgaacttcaggaatatttccccaacaatacctactttgtgacaggatctctgttcacagattttgttgaagtctttggcagcgagatataagtagctcaacaagtcctccggtttatttttctggatgatgggctgtgctgtatccagataaagatcgcgcagacgggcggcctgtccccgttctttctcacgaacgacagctgcataatagaatttggcaatgcaatcactgtataacacagacgcaagtatgattggtaaaaccttgagccagtttaccttaaaaccggattgctcattttcgataccactgccgaaagcaagtgataccaccggtgtattggtgtatccattctcaatcaatgccttttttatcagtgaaatatagttgctggcacgacattgtccaccggtttgtgtgatggcaacgcacgtattggcaggatcataacgtccgcttttaaaggcttttactatgtcgccgacaatcaatgttgccggataacatacctcattattggagtatttcaatccccagtcgcaagatgcggtgtcgctcaacggtaacgtttccatttcatatccggccactttcatgatggatggaatgagtggtgaaatgaaaggcgtaaagaatggagcgaggattttcttctttttgtctttcttggtgaaaggagcagttgaaacaaatggctcgggatctttcgcttgagaatgtttcaaactgaaattcaagctttccaccaacgagcggactcgtaatttgatggagccgatattattaacatcgtctatcttgagcaaagtaagattcttgccgtatcgtttcagcaagttacgtacttcatctataaggaaagcatccggaccgcagccaaaagaagtcatctgcatatattgtatgtcaccctcttgcattgccgcccacttggttgctttcagaatacggttggtaaatgcccattgagagaggtaatgagtcttttccaatgaaatctcctgctggcggacaatatcatcagttatcacataaactcccatcgcagcaatcatatccgaaaccttgtgttgtatcagtggatcgctatggtaagggcgtccggcgagtaagataatcagtttgtgtttttcccgtccctcgttcagaacttcctgattataggcagcaattttttcttcgaaagcatattgttcctgtaatgcgcgtgagaaggcatttttgcatacctcatccctgatacccaaagatttcagatattcatagcattgtttatacagcaatgcttcatctttgaaggtgatagtcggagcatctatcggtatattctcttcctgtacacttttgatgacttccgaataaccggaaacgatggggcaattatagctgttttgctgttgcttatcctttttctcgaaaacaacgaacggcataaatatccggttgacgttttgctgtgtcaggttacggatatgactgtgcacaagtttggcagggaagcagatgttatcagacatcaccatgccggcagcagtctcgtatttgctgaatgtagagggttccgacaactgtacctgaatgccgcaagcagtaaataaggtatgccagaaagggtattcctcatacatgttcagaatacgtggaatacctatggtgaataggggttgtggaatgtctgcgctccggtcgaataataattccagctttttatcatacgtattgatgcctttgtccgcatggcttcctttattggaaaacaccttctcacaccggttgccggagaagtaatggtttttactgttgaacgtatatcgcatgatggcgcactggttctcgcacccccggcattgaagttgcttggaagtatattgtgcccattggagcatctcgttcagctccgtcacccgggcattttcgatttgtttggcatatagggcacaaccaagagcacccatcaattcaggacagttactgcggaaggtttgtttcccggtcagcttttccagacttcgtacgatggaatcattacgcatggttcctccctgcacgacaatatggtcgccaagtatctccgtgtcttttaattgcagaaccttatacaggcagtttttaacaacggaataagataatccggcagctatatccgctacggacgctccttcccgaagtacctgttttactttggagttcatgaagactgtgcaacgtgtacccagatcacatggtgcttgcgaaaaacaagctgctttggcaaagtcctccacactgtaatccagcgattgcgcaaatgtgctgataaaagaaccgcaaccggaggaacaggcttcattgatttcgattctgttgattactccgtcgttcacaaagatggctttcatatcctgccctccaatatccaggataaaagaaacttctttgctgatatgtttggcagcagcataatgagcgatggtttcaatgattcccgcatccatgtggaaagccgcttttatcagatcttctccgtaaccggtagaacatcctccttttatgcgcagggtagttcctcgtctccggcattcttcatgtagtttctgcaagccgttctctactgtttttatagggtttccgttgttgtcgtgataataggagtaaaggatacgatgattgttgtcgagtactacgattttggtggtagtagagccggagtctatgccgatagttgcttcctgtaatccgggacgcagactggcatattgaattttatactggtctttttcttttttccatgaccgatattcttcctcactgtcgaatataggagaaagatcactctggaaaggtgaggtaacacttagtttgttttctattacctgtatcaggttggagagatgaatactttcttcattgttctctgccaatgctgctccccaggcagggatcagatttcctttttccggtaatatgaaatctgtatcttgtgacagattcagatagttgtcaaatgctttccgaagggccggaataaaagtcaatgggccaccgcagagtaataccggagctacgatattgcaaccgcgtgcaagtgtgacagtggtctgtacggctactgcatggaaaatggaagctgctatattttctttggatatatttttggctatcagattctgtatgtccgttttgcagaatactccgcagcgtgaagcgatagagtatacctgattggaacgaagtgctagttcattcaattcgtcgatggagactccaagcagaatagccatctggtcaatgaaagccccggttccgccggcgcaatttccattcatgcgcaggtctgtagcctgtccgtcctgaaagaaaacaactttcgcatcttctcctccaatatcgatcatagtggctgtgtgcggatgctcccggcgcacatagtttgttgcagctacaacctcttgcacaaacggcagagagcatttctctgaaattcccattccaacagagcccgtaatgtggaaagataaaggaatatcacccaactgttcctttatttgataaagaaatctgagtaaacattcttgtgtttttgcctgatgccttttgtatccggaaaacaagactgtagttccatctttatccaatactaccatcttagtggtagtagagcctatatctaaacccactttatatacattcatataccaaatatcttaaattagacctcgtgtttgacatctgtgtcagacgcaaatgtatgtaaaaatatggtagatacggcaaatcgtaattgaagtttttgatttaattaacgaattgggaaaaaagaaagatggaatgtgagggaggaaaacgatcgtgtaaaaaaagacgtaaatgaataattgtgtatttatattacttgttgggttgtagtagatcttttatggtgaatcttagaaatcttgtttactctatttttgacaaaaggtaacgtggattttaataaacccggattctgtttataataaactttttgatagttttagtaaaacggtattcgagtttattataaactattgtagaacagttttaggatcagacgagagattttaagctgaattataaacaaaatggggcaataatcattcgactattgccccatattgtataggagtggtattgtaaaataccaggttatttatgatttatgtatgattatttctttctattttcatgttgtttatactttttcttttctcaaagatacaacataaaaagtcatttgtcaagagtctgatgagaaaagtagcttatcggtctcaaaacagatgaataactttacttctaatatccgatttttattcggctttattacagaatcggggatttgggtacaaaaatccgtaattgatatacaattccattcgttttatcgcagtaaatttgcaatcagaagtttaacaatgaaaagatagaagatggtgataaaaacaattctaagtgttttgtctttattcgttatgttatcatgcagtatgacagggaaaaaggatataaaacagcagcctggtatgtgcgccaaattacctatggcggctgacggtattgtgcggctatcgaaaatcgaggtttatctggagtatcttgaagaatatatgaaatatgcgaccgaagtgggtgaagtctccttgcgtactgaaccgggagtgctgactatgtatgccgtcagcgaaaaagagaatcctggcaggataactattcttgaaacttacgcgagtcaggaggcttataaatctcatattgcatcggagcattttcaaaagtacaagcaaggaacgctgcacatggttaagactctcgtactctctgaccaaacgccgcttaaccccgcaaattgcattaataacttcattcaataaacgaaatgattatgaataaactccttttattttcagtatttagtattttaacactcaatgttatggcacaagaaaagatagtacagacggcaggacgcgaccagttaggaacgtttgcccctaagtttgcggaacttaatgacgatgttctctttggagaagtttggagccgcactgacaaactcggtctgcgtgaccgcagtttagtaaccattacctcccttatcagtatgggaatcacggacaattcgctcgtttatcatcttcagtcggcgaagaagaacggcatcacccgcacggagatcgcagagattatcactcatataggtttctatgcaggttggccgaaggcgtgggcagcgttcaatttggcaaaaggagtatggtctgaagatattgttggtgaggatgccaaaacagctttccagcgtgagatgattttccctattggtgaacccaatacagcctatgcacagtattttattggtaacagttatcttgctccggtttcgcgcgagcaggtgaatatctctaacgttacttttgaaccacgttgccgcaataactggcatattcaccgtgcaacgaaaggtggcggacagatgcttatcggtgtagccggtcgaggctggtatcaggaagaaggtaaaccggcggtagagattctgcctggtacggttatccatattcctgccaatgtgaaacactggcacggagctgctgccgacagttggtttgctcatctggctttcgaagtttccggtgaaaacacttccaatgagtggcttgaaccggttacagatgacgagtataacaaactcaaacagactaaacgatgatttttgctaatcctgctttatcttttgaaaggaaataatatgactaccgaggaattttaaggaatatgtaaagacgcgcaaagcgcttaatacaggagaaatacatcgtttgatggacgatatgagcaattatcaaagtaatagaagaatgaaaacgcctgtggggttactccatcgtgataatgtctaaactaattaatgataagaaatatttaaaatcaaaataaaatgaaacagattatattcatatttatgagtctcctttgctttagctgctcatcaaaagcgcagaatcagacagcggatactaatgtacagtccgataagaaaatcctggttgcctatttctcttgtactggaactacagaaaaagccgccgatgccattgcaaaaacggttggcggcaaactttatcagataactcccgctacagcctatacctcggcagatctcgactggaacaacaagagtagccgtagttcaattgaaatgacgactgaaaattcacgtccggaattggggggagaagcgcttaatctgaaagattacgacgtgatattccttggttacccgatatggtggaatttatgtccgcgtccggtcaatacattccttgagaaatatgatttctccggtaaaaccgttattccatttgctacttccggaggaagctcaataactaatagtgtaaaacaactcaagaaactttatccaaaaatcgtatggggagaaagccgattgttgaacggaagtgtcaagcaggccggagagtgggcgaaaggagtaatataaaaatggctactgaaaatatattcactaaatatgagaagttaaatagggcggaagtaatagtgaatatattaaatgagtaagtatattacgaatcatatttagattatgcttttagaaaaactacttaaagaatttaattttagtactaatatttttaattgggaggagtttaagttattcgaccaatattttgaacgaatattagttagtaaaggtacatttttgattaaggaaggagaaacagagaggtatagttatttcgtttttgatggaatattacgttgttggcttttaaatcataacggggaagaacaaactttctggttttgtaaggagggtacgttttcaatgtcaaacatatcttttacattacaaactaggtctgcatttaatgtgcaaacaattgtagatagtgttatttaccgaatagacaagaagcaagtaaatgaactatataccgctatccctaaagtaaaaactgtatttgaagatttaaatgctatattgttgaataaacttttgaaaagaaatatcgacttaattaaatattctcctgaacagtattatctacagatgatggaagaatatggtattacattaaactatataccattaaaagatatagcttcttatttgggtatcacaccgcaagcactaagcagaatccgtaaacgtattttttaacttgggttcagtgttttgaatgtataagtaacgaactttgcggctttaaattgcaattacaagtatgattagaaaaattaaagttacggattatccacgtttgatggaaatttgggaaagtgcagtattgagtacacatgattttcttaaagaggaagattttctatattataaggaacgacttccggtatattttcagtatgttaatctattcggatttgaacaagagggaatcttaatcggatttatgggaattgcagaaggaaatcttgaaatgttatttattgacaataagtatcgaggcgcaggaatcggaaaaaaattaataacttatgccatagataatttgcaagtaactaaagttgatgtgaatgagcaaaatgttcaagctgtcggtttttatgaatatatgggttttaacatatataaaaggtcgaatttggacggagaaggtaaggaatatcttattttacacatgcagttgtagtctctgttcaattataaacagatgcttagtataggtacctttaattgaagatgtaatgttacatttgaataaaatgattggttaaaaaatcattgtagagtttgaatgggcacatctatcgcctacttaaactctgttttaaatgaagtgaagaaaaagaaaaaagctctgaatttcttgaatttcagagctttgctttaatttactatttgctttcgcggtgcgtacgggactcgaacccgtgaccccatgcgtgacaggcatgtattctaaccaactgaactaacgcaccaaattttaattggattaactcatttatatttctctctgcttcttagtgaaagaagcggtgcgtacgggactcgaacccgtgaccccatgcgtgacaggcatgtattctaaccaactgaactaacgcaccagaatttcaatttattaatctgcatctctctcgattgcgggtgcaaaggtagttgttttttgtaaacctgcaagcgttttgagaaaagtttttttcaagaaaaaacaagaaaaatgcttagtgtctcattttgagtacttttgtaatgaaaaaaaatattcgtttttcttctcttcggatagtgacggtatctgatcgttatagtgacgctatcacgatggaataccgtcactatccgaaggcaatggtatcactatcctaaagtttgtcattcttttcattgaaaataactctcgatatctttctatctgtaagaaatcaccgtttttatatcaactttctgcttgaataattcgtaattttgcaataaatcgttatttttgcggactaaaattagaaaggtagaaaataatctgcctagaatcgttaattagtagaaagaatgatgacaacagccaaactgttattgcactgtcccgacaaaccgggaatcctagcggaagtgacagactttattacggtaaacaaaggaaatattatctatctggatcagtatgtagatcatgtagagaacatcttcttcatgcgtattgaatgggaactgaaagattttctggttccacaggaaaaaattgaagattatttcagaacactctacgggcaaaaatatgaaatggattttcgtctttatttctctgatgtaaaaccacgtatggccattttcgtatccaagctgtcacactgtcttttcgatatgttagcccggtatacggcaggagagtggaatgtagagatacctcttattataagtaatcatccggatttgcagcacgtagcagaacgtttcggaattcctttctatctgttccctatcaccaaggagacgaaagaagaacaggagcgcaaagagatggaattgcttgccaaacataagattacatttattgtattggcacgctatatgcaggtgatctccgaacagatgattaatgcttatccgaataagattatcaatattcatcattctttccttcctgcgtttgtaggggcgaagccttatcacgcagctttccagagaggggtgaaaattattggtgcaactagtcattatgtaacgacagagctggatgccggaccgattattgaacaggatgtagtgcgcattactcataaagatgctattgaagacctcgtaaataaaggaaaggatttggaaaaaatcgttctttcgcgtgcagtgcagaagcacatcgagcgcaaagttttggcttataaaaataaaacagtaatatttagctgatgaaagtagcagttgtaaaatacaatgccggcaatattcgttctgtggattatgctttaaagcggttgggggtagaagcggtgattactgctgataaagaagaactccaatcggccgataaagttatttttcccggagtgggagaggcggaaactaccatgaaccacttgaaggcaacgggactggacgaactgattaagaatctccgtcagcctgtatttggaatttgtctcggcatgcagttgatgtgccggcattccgaagaaggagaagtcgattgtttgaatatctttgatgtggatgtgaaacgttttgtcccgcagaaacatgaggataaagtgccgcacatgggatggaacaccattggaaaaacgaatagtaaattgtttgaagggttcaccgaagaagagtttgtctattttgtgcatagcttctatgtgccgacctgcgactttactgctgctacaactgactatattcacccgttcagtgctgcgctccataaagataacttttatgctacccagttccatccggaaaaaagtggtaagacaggagagaagattctgacaaactttttaaacctctaagatacaaatagtaaatagatgatagaaattattccagccattgatattattgatggaaagtgcgtacgcctttcccagggagattacgatagtaaaaaggtgtataatgagaacccggtggaagttgcaaaggagtttgaagcgaacggtgttcgcaggctccatgtggtagacttggacggtgctgcttctcatcatgtcgttaactatcgggtgttggaacagattgctgtacgcacttctcttgtcatagattttggtggaggagtaaagagtgatgaagatttgaaaattgcttttgagagcggtgcgcagatggtaaccggaggaagcattgcagtgaaagatccagaattattctgtcattggctggaaatatacggcagtgagaagattattttgggggcagatgtaaaagaacataagatagccgtcaatggttggaaagatgaaagtgcctgtgaactttttccatttctcgaaaattatatagataaaggtatacgaaaagtaatctgtacggatattagctgtgacggaatgttgagtggcccttctatcgatttgtataaagagatgctggcaaaattccctgacctttatctgatggctagtggcggggtgagcaaggtggatgatattgttgctttggatgaggctggtgttcccggagttattttcggtaaggcattatacgaaggacatatcaccttacaagatttgagaatctttctgtaatgagcgtatcggaataaataagatacctttataataagggagataagaatcaagcttcaggaatatagattataaattgttgaacaataaataaaataggattgtgttagcaaaaagaatagtaccttgtctggatataaaagacggacaaaccgtgaaaggaacgaattttgtcaacttgcgtcaagccggtgatccggtggaactaggtcgtgcttacagtgaacagggggcggatgaacttgttttcctggacattactgcaagccatgaaggacgtaagacttttacggaattggtaaaacggattgctgctaatatcaatatcccatttaccgtaggtggtggaatcaatgaattaagtgatgtagaccgtctgctgaatgcaggggcagataagatttctatcaattcttccgctatccgcaatccccggttggttgacgagatagcaaagaatttcggctcacaagtttgtgtgttggctgtagatgccaaacagaccgaaaacggttggaaatgttacctgaacggaggacgcatcgaaacggataaagatctgttcgagtggactaaagaagcacaggaacgcggagcaggagaaatactcttcacaagcatgaatcacgatggtgtaaaagccggttatgcaaatgaagcacttgccgctttagcggatcaactctccattcccatcatagcttcaggaggtgcgggctgtaaggagcacttccgtgatgtctttttacagggaaaggcagatgctgcattggctgccagtgtttttcacttcggagaaattaaaattcccgaattaaaatcgtatctttgcggcgaaggaattaccatcagggggtgaggcaccccggccgggttttcctgcggatggattatatagtcagataaatataggaactgtctgcaaaagaattccgtaggcgaataggtagtaattgtaaattggaatagtaattagaacttatataaaaatggaattggatttcgataaaatgaacggactcgttccggctatcatacaggacaacgagacacgtaaggtcttgatgctgggtttcatgaataaagaagcttatgataaaacggtggaaaccggaaaagttacattctttagccgtacgaagaatcgtttatggacaaaaggcgaagaaagcggtaacttccttcatgttgtatctataaaggctgattgtgacaatgatacattattgattcaagtagaaccggtaggtcctgtgtgtcatacaggcacagatacttgttggggggagaaaaacgaagaaccggtcatgttcctgaaagcattgcaggactttatagacaaacgtcacgaagaaatgcccgaaggttcttatacaaccagcctgtttgagtcgggaatcaataagatagctcaaaaagtaggtgaggaagctgtggaaacagtgatcgaagcaacgaacggtactgacgaacgtttgatctacgaaggagccgacctcatttatcacatgattgtattgcttgcttcaaaaggctatcgcattgaagatcttgcacgtgaactgcaggaaagacatagcagtacctggaagaagcattaataagtaaagattagaaattaaaaattaaaacgggagtcggcatggatgacggggcgttgatacaatataagaacgtagaaatccatcaacaggaactctgtgtgctaagtgatgtaaatctggaattgcacaaaggagagtttgtctatttgatcggaaaagtaggctcggggaaaacgagtctgctcaagactctttatggcgaactggatgtaattgacggtgaagcggaagtgctgggctataatatgcgatctatcaaacgtaagcatatcccgcaattgcgccgcaagttaggcattgtattccaggattttcagctgctcacagaccgtactgtatataataacctggaatttgtgcttcgtgccacaggctggaaaaacaaacaggagatacaggagcgtattgaagaagtgcttcaactggtgggaatgtccaacaaaggttataaacttccgaacgaactttccggtggcgaacagcagcgcattgtgattgcacgtgccgtactcaattctccggctatcatcctggcggatgaaccaaccggaaatctggatgtggaaacaggtaaagccatcgttgaattgttgcacaatatctgcgaatccggctcatcggtagtgatgacgacgcacaatttgcaactgttgaaagattatccgggcagggtatatcgttgtgccgaccatcagattgtagatgtgactgatgaatatatgcccagacagagaacaatagaaatagatttaaatatagataactaaaacagtaacgaaaatgaaagttttaaagtttggaggaacttccgtaggttctgctcagcgcatgaaggaagtagccaaattgattaccgatggtgaacagaagattgttgttctttctgctatgtcaggaacaacaaacacattggtggaaatttcggactatctgtataagaagaatccggagggtgccaacgagattattaataagctggaagcaaaatataaacagcatattgatgagctttttgcaactcaggaatataaacagaaaggtcttgaagttgtcaaatcccacttcgactacatccgctcctatactaaagaccttttcactttgttcgaagagaaagtggttttggcacagggagagcttatctctacggcgatggtaaacttttacctgcaggaatgcggtgtgaagtccgtgttgcttccggctttggaattcatgcgtactgataagaacgcagaaccggaccccgtatatattaaggataaattgcgtgctcaattggatctttatccggatacggaaatctacattacgcaaggtttcatctgccgcaatgcttacggtgagatagacaacctgcaacgtggtggtagcgactacaccgcttctctgatcggagcagcagtgaacgcttccgaaatccagatctggacagatatcgacggtatgcacaataacgacccgcgtattgttgacaagaccgctccggtacgccagctgcacttcgaagaagcagccgagttggcttacttcggtgcaaagattctgcaccctacttgtatccagccggctaaatatgccaatatccctgtccgcctgttgaacacaatggatccggaggctccgggcacactgatttctaacgacacggaaaaaggcaagatcaaggcagtagctgcaaaagataacatcactgctattaagattaaatccagccgcatgttattggctcatggcttcttgcgtaaggtgttcgaaatcttcgaaagctatcagacatctatcgatatgatctgtacgtcagaagtcggtgtatctgttacgatagataacacgaaacatcttaatgagattctggatgacctgaagaaatacggaacagtaaccgttgataaagaaatgtgtatcatctgcgttgtaggtgaccttgaatgggaaaatgtcggttttgaagcgaaagcacttgatgcgatgcgcgatataccggtgcgaatgatctcgtttggaggaagtaactataacatctccttcctcattcgggagtgtgataagaaagtagctttacaatcgttgagcgatatgcttttcaacagcaaataattccacaaataatacgagcgcttttaccgaactgataaaagcgctcttttttaaccaactaaacaagtttttcgaattatgaagggaatatttccaatcgataaattccgcactttgcagacgcctttctattattacgataccaaagtgctgcgcgatacattgtcggctattaaccatgaggttgccaaatatcctaattattcagtgcattacgctgtcaaagcaaatgccaacccgaaagtacttaccatcatccgtgagagcggaatgggagccgactgtgtgagcggtggagaaattcgtgccgctatccgtgcaggatttccggccaataaagttgtttttgcaggagtaggtaaagcagactgggaaatcaatctcgggctggagtacggcatcttctgtttcaatgtagagtctattcccgaactggaagtaatcaatgaattggccgctgctcaaaataaggtggctaatgttgcttttcgtatcaatccggatgtaggcgcacatactcacgcaaatatcactacaggtttggcggaaaacaaattcggtatcagcatgcaggatatggacaaggtgatagatgtggcgcaggagatgaaaaacgtaaagtttatcgggcttcacttccacatcggttcacagattctggatatgagcgattttgtagctctctgtaatcgtgtcaatgaattacaggataaattggaagctcgcagaattctggtagaacatattaatgtaggaggtggtttgggaattgactacggacatcccaaccgtcaggctattccgaacttcaaggattactttgctacctatgccggacaattgaaattgcgtccttatcagaccttgcattttgaattgggacgtgcagttgtaggacagtgcggttccttaatctctaaggttttgtatgtaaaacaaggcacacggaagaaatttgccatcctggatgcaggtatgaccgatcttatccgtccggctctgtatcaggcattccataaaatggaaaatattacttccgaagaaccattggaggcatacgatgtagtaggaccgatctgtgaatcgtcggatgttttcggaaaagcaattgacctgaacaaagtgaagcgtggtgacttgatagcccttcgctctgctggtgcttatggtgaaataatggcttccggatacaactgtcgtgaactgccgaaaggatatacttccgacgaactggtgtaagtaaaaaatgaaccgctacaatcaaaatgtgaatgtagtttaaaaatatagggtgcatggaacaattttaactgaaagcttgttatttttgtaatgagttcaaaaagaaactacattaacaacttaataaaaaatacgattatgatttcagaaaaattacagaatgcaattaacgaacagattactgctgaaatgtggtctgctaacctgtatctagcaatgtctttctattttgagaaagaaggtttcagcggttttgctcattggatgaaaaagcaatcccaggaagaaatgggacacgcttatgcaatggcagattatatcatcaaacgtggaggaactgctaaagtagataaaatagatgttgttcctaacggatggggtactcctctggaggtattcgaacacgtatacaaacatgaatgtcatgtttctcaattggtagacaagctggtagacgtagctgctgctgaaaaggataaagcaacacaggatttcttgtggggatttgttcgcgaacaagtagaagaagaagctacagcacaaggcattgttgacaagatcaagaaagctggtgataccggaattttctttgtagactcacaattgggacagcgttaatgatgttactctgaaaaatagttctttaatatattatagaagctgcctgaattcctgttcaggtagcttcttttttttcacttatttggcttatgttcgaaaataaactacctttgtgttacgagtcggagagaaattaatcccagttattataaatgaatggtttgaacagaggaattataagattgctccttttatctttattgctccttttaggggtgagtagttgttctcaaaaagaggaacgacgtatcttagttgtccactcttatgaggagacttatgcggcttatccggaatttaaccggatgatagcggagcaatttgaaaaagagaaaattgatgctgatattcgtaccgtttatttagactgtgaatcctactgggaagagccggaacttgagcggatgcgctttctggttgattccgtatcgaaagactggcggccggaagtgattctggtgaatgaagaccaggctacttattcattgatgaaatgcggaattcagttggcgaaagaagtgcctgtggtttttggtggtgtcaattatccgaattggggattactgaaacatcatcccaacgtgacaggcttccatgacaagatagcctttaatgagaatatcagtgtggcaaaagagcttttcggtgagcacgttcgtttgtttaccatgctcgatactacctatatcgacagacaaatcagaagagatgcaaaggaacagtttaaaggacataaagtgaccggattcatagataatcccgaactttctcctgaagaacagatacgtttggcacaggaagaaggttatacccgtttcatggctattcctttgcgtaatgccagaaatcattcggatgctacttttatgtgggttttaaacaggagttaccgcgatcaatgttatatccagttgaaacgtgattacaccactattaatattgggagtatctgtggtagtcctagtctgacagctattaatgaagcctttgggtttggtgagaagttgttgggtggatacatcacttcgctgcctattcaggtagaagaagaggtgaaaactgccgttcgcatattgcatggcgcaagtccctcggatatacccattgttgaaagccggaaagagtatgtcgtagactggaatacaatgacgcaaattggtttgagtaaggaaagtattcctgctaactatcgtattatcaatattccgttcagagctgaatatccatttttgtggggagccttagtcgcttcatttgttcttttcctgattttactttttgcttctctttggtggctatatcttcgggaacagatgaggaaaaaacaggctcttatagcattggctgatgaaaaagaaacattgtcattagccattgagggtggaatgacgtatgcttggagattggataagggttgttttgtttttgaagatgcattctgggcgtcgcaagggttaaatcctagacaactttcgtttaaggaattcatgagctttattcatcccgatcattgggagggagtgaagttcaactggcgaaatctgaaaagtgctcataaaaaaattgtgcaggagctttgtaacttcgacggtaaaggctatcagtggtgggagtttcgttatactactaaacagctttcgggtggtgaatataaaacagcaggtttgctgctcaacatacaagatataaaagatcgtgaggaggaactggaagctgcacgcttactcgctgaaaaggcagaattgaaacaatcattcctggcaaatatgagccatgagatacgtactccacttaattcgattgttggctttgccaatattctggcattggaagatggattgagttccgtagaacgcgaagaatacatcggcactattaataagaacagcgagttgctgctcaaattgattaacgatattctggagctttctcgtatcgaatcaggctatatgtctttctcgtttaagaaatgtagggtgagagagctgattgatgacatttatatgactcaccaggtattgattgctccacgcctggaattcctgaaagaagtggataatatacctttggaaattaatgtggatagagagcgcttgatacaagttctaacaaatttcttgaataacgccagtaaatttacggaaaccggatatatcaaattagggtatatttatctgccggatgaggggcatgtgcggatttatgtagaagatactgggagaggtattccacgcgaagaacaacggatgattttcagccgtttctacaaacagaacgaattttcacagggagcaggattggggctttctatttgtcaggtaattatagaaaaactgggtggaaggattgaactcaaatccgaagtaggcaagggaagtcgctttacggtcatccttccttgccgggtagtgtcttgataaaacttaataggagggattgtcaaccgtgttattttttgtttttccctttctccatcgttcccaagtaaatctccagtgaacgggtggaaatctgtatttcgcggaaagatacgcctagagaggctatcaacagaatcagtgccagtccgaatacgtaagcagaaaataattgcagtccgatataaataagaaacatactgactacgcaaagaaaaagacttgcaatacccagtccttgcattgtacgggtcaggttcaaccgtttccgtaaattctcgatttgagcttcagtgatatccgaagggttctccacgtagcggtcacgcagttggcgcacaagttgggcatacgataagaaacggttggtgtaagccaacaaaatcaatgaaactgccgagaaaagtagggcaggagtagtgagggtcagttcttccataatctattttttgtagtcaagtagcggttcaaaattcattttataaaagagaatttaggtgcagattacatagatttcacgtattatacgttttttagaatgaagcttgttataaagcaactgtgtaagatacgtgaaatctgtgtgatccgtgtaatccgcgcctaaaatatagattccgcaaggaaaccttgcttcggagttattccgctttcaatacgttgagttctttacctaccttgataaaggcagcgatacacttgtcaagatgtgctttttcgtgtcctgcagaaatctgtacacggatgcgggcctgatctttcggcactaccggatagtagaaacctgtcacatagattccttcttcctgcatacgtgcagcataaatttgagacagtttcgcatcatacagcattaccgcacaaatagcactttgcgtcggtttaatatcaaatccggcagccgtcatcttatcacggaaatagtttacattttcaaccaacttgtcatgtaatgcattgctctctttcagcatcttgaaaacttcaagacttgcaccgatgatacccggagccaatgagttggagaacaaatacgggcgactacgttgacggagtaaatcaatgatttctttacgcccggtggtaaatcctcccagtgcaccgccgaaagccttacccaacgttccggtataaatatctacacgtccgtgagtcttatacaactcgcttacgccatgaccagtggcacctaccacaccggcagagtgagactcgtccaccattactaacgcattgtatttctcggcaagatcacaaatctgatccatcggagctacattgccatccattgagaacacaccgtccgtaacaacaatacggaaacgttgtgcctgcgcttcttgcagacatctttccaggtctttcatgtcagcattggcataacggtaacgtttcgctttacaaagacgtaccccgtcaatgatagaagcgtggtttagcgagtccgagatgatggcatcctcttcagagaaaagcggttcgaatacaccgccgttagcgtcaaagcaggcagcatacagaatcgtgtcttcagtctggaaatagtccgaaacggcagcttccagttctttgtgtatatcttgtgttccacaaatgaaacggacggatgacattccgtatccacggttgttcatcatttcctgcgaagccttgattaatcggggatgattggacaatcctagatagttgtttgcgcagaagtttaatacttccttaccttttacagtgatggcagcttgctgcgcactttcaatcagtcgttcttctttataaagtccggcttccttaatttcagccaatgtttggcggagatattcttgcattttaccgtacatagtgtttgggtgattaagttatattgcaaaggacacaatttttcttggaataacaatgtctttttgattaaaatctgaaaaaaaagtgcttactttgcgcactatttaagcttgatattctaagtcagaagaaaaaatggaacacattttgattattggagctaccggacagatagggtcggagctaacgatggagctacgtaaacgttacggaaatgcaaatgtagtagctggttatattccgggtgcagaacctaaaggggaattaaaggagtcgggaccgtcggctattgctgatgtaacggacggcgaggcgattgcatctgtagtaaaagagtatcatatcgatacgatttataacttggctgctctgttgtctgtagttgccgagtcgaaacccaagctggcttggaaaataggcatcgatggattgtggaatgtgctggaagtggcacgtgaacaagggtgcgcggtgtttactccgagttctatcggttcgtttggcgctagtacgcctcacacgaaaacaccgcaggacaccattcaacgtccccgtaccatgtatggagtcactaaagtaacgacagagttgttgagtgattactattttaataaatacggtgtcgatacccgtgctgtccgttttccgggcattatttcgaatgtgacccctccgggaggaggtacgaccgattatgctgtcgatatttactactcggcagtgaaaggagaaaagtttgtgtgccccattaagcaaggcactttaatggatatgatgtacatgccggatgcgctgaatgcagcaatcacactgatggaagccgatccggcaagattgatacatcgcaatgctttcaatatcgcttccatgagtttcgatccggaaacgatatatcaagctatcaagaagcatgtgccgcagtttgagatgatttatgatatagatcctttgaagcagcgcatagccgatagctggcccgatagtctggatgatacctgtgctcgtgaagagtggggatggaagccggcctacaatttggaaagcatgacggtggatatgcttgaaaagttaagagagaaactgaaataatgaaaaaactaattgcaggggtcatactgctcggtatattgagctcttgtggaaacaagaaaacaaatattgaccccttcgcatctattactaaagaggtggattcagtccggcagatagccgattctagccaccatgataaatcgccggaagatccgcagcctatacaggcggatgaatctttcgatgattttatttacaattttgcttccgatgatgtgttacagcgtcagcgtgtgaaatttccattgccctactacaatggagataagaagtcaaacattgaggaacgcaactggaagcatgatgacttgtttaccaaacagcattattatacactgctgtttgatagagaagaagacatggatttagtaggagatacctccctcacttctgtgcaggtagagtggatgttcgtgaaaacacgaatggtgaaaagatactattttgaacgtatcaaaggtgcatggatactggaggcaatcaacctgcggcccattgaacaaagtgataatgaaaactttgttgagtttttcggacattttgcaacggatagtctttttcagagtcagcgtgtgcgggagccgttggcttttgtaaccagtgatccggacgatgatttctccattttggagacaaccctcgatcttaatcagtggttcgccttcaaaccggtacttcctgtcgaccgcctttctaatattaattacggacagcggaatgacgatgattcgcccacgaaaatcctggcgttgaaaggtatcggaaatggtttttccaatatcctttatttccgccggaaagccggagaatgggaattgtataagtttgaagatacaagtatctgatacaggttaagatgcactataacagtataacttataactaaaaatatatgtattctcttttgccctacaatacattcggcatcgatgtcagtgccgctcgttttttagaatattcttcggttgaagaactgaagaagctgattgtgcaaggtgccattgtgacaccttttttgcatattggtggcggcagtaacctgctgtttaccaaagattacgacgggttgatactccattcccgcattgaaggaatcgaagtgacggaggaagatgaacactctgtgtcggtacgagtgggagcgggagtagtatgggatgacctcgttgcatattgcgtagaacatggatggtatggaacggagaacctgtcgctcatccccggtgaggtcggagcgagcgcggtacagaacatcggagcttatggcgttgaagtgaaagatctgataacagctgtggaaacggtgaacattcaagctgaagaacgcgtttattcggtggaagagtgtggatatacctaccgcaacagtatctttaaacgcccggaaaacaagtcggcttttgtcacctatgtccgtttccgacttagtaaaaaagaacattatacgttagattatggaaccattcgtcaggagcttgaaaaatatccggcattgacgctttctgttgtacggaaagtgataattgatattcgtgagagcaagttgcccgacccgaaggtaatgggaaatgccggcagcttctttatgaatcccattgtgccgaaagaaaaactggaagccctgcagcaggaatatccccggataccttactatgagctggcagaagatcgggtgaaaattccggcaggatggatgatcgaccaatgcggctggaaaggtaaggccttaggtccggctgccgtacatgataaacaagcgctggtgttagtgaatcttggtggagcaaaaggtagcgatattcttgcgctttcagatgcagtccgagcctctgttcatgagaagttcggcattgatatccacccggaagttaacttaataaattgagaagtaacaagtgaaagtaagaatcattggaagtggaacatcgacgggagtaccccaaatcggctgtacatgtccggtttgtacttctaccgatccgaaagataaccgattgcgtgcatctgctattgttgagacagatgatgcgcgaattttgatagattgcggtccggatttccggacacaggtattgcgtcttccttttgagaagatagatggtgtgctcattacgcatgaacattatgaccatgtgggcgggttggacgatttgcgtccgttttgccgatttggttcagtgcctatttatgcggaaaattatgtggcacaaggcttgcgcttgcgtatgccctattgttttgttgaccatcgttatccgggagttcccgacattcctttgcaggaaatctcggtgggacaggctttttcagttaaccacacggaggtgcttcctttacgtgtgatgcatggccgattgcctattctgggatatcgtatcgggcaattaggttatatcactgatatgctgaccatgcccgaagaatcctatgaacaattggcgggaatagatgttttggtagtgaatgcacttcggattgccacgcatcctactcatcagaatttggaagaagcattggcagtggcgcagcgcattcaggcaaagaagacgtactttatacacatgagtcatgatatgggcttgcatgcggagattgaaaagagccttccggaaaatattcacctggcattcgacggattggatatctatctttgattatcggtgaaatttttagcaaaagttttgttttctttgtagaaattattatttttgcacctagccgataaacagcgaatattatgaaacttcgtacgatagtgaaaatagcgatcacgtcttctgttgtacttttgtgctcaggtttcgcattgtactctttttttagactgtcggcggccgaagggcagaaagattttgatctttatgaactggttccatccaccacttcagccgtatttgttaccgatgatgtgctcgagtttgtagcgggggtcgatgatctgacttgtagtaaaaatcagcaatatctttatgtatccaaacttttttcttatctgaaacaaagcctttatgccctctcggaagatactccccatggcttgagtcggcaaatgaatcagatgctgattagtttccacgaaccggataacgaacggaaccaggtactttattgcagattgggaaatggggataaagaattggtgaacaggtttgtgcgtaaatatatatcttcgctttatccaccgaaaacgtttgtttacaaaggagaggaaataatcatttacccgttggcagatggtgattttctagcctgctatctgacgtctgattttatggcgttaagttttcagaaaaaactgattgaaaacgttattgatgcatataagagtgacaaatcattggcggatgatccgacctttacaggagtgcgtgctccgaaaaaaagtgtagcggccgccacaatctatacccgtatgaaagggatgatgggatggacggaatttgacatgaagatgaaagatgattttatctatttctccggcatcactcatgatgcagatacttgctttgcatttataaaacaacttcgccagcagcaatcagtcaaaggcttcccgggtgaagcactgccctccactgctttctattttagcagacaggggattacggactgggcgtctttactttcttatggaaatgcgcaggagcagaacggggcagtccgcacgagtgaagtgcagaatagagataaggaattttcccgctatctgatggaaaatgccgggcaagacctggttgcctgtctctttcagcgtgaagatacgttgcaggatgcagcggcagtcttgagcctatctgtggcagatgtgacggaagctgaaaggatgcttcgcacccttgtcaatactgctccggcagatgaaggaagaaaaactccccgtattacttttggttatactgtaaataaggcatacttggtctatcggttgcctcaaacaacattgtttaaacaactgaccagttttgtggaggccactttggatgtgtatgcggcgttctatgacgggcgtttgttgcttgctcctgatgagaatgctctgtcacaatatattcgccaactggataaaggcgaagtgcttaatggagcaatggcctatcaggcaggcatggatcacttgtctgattcataccactttatgttgatggcggattttgaccacatatttcggcaatcagaaaaccacgttcgttttgtaccggatttttttctgcgtaacgccgattttttccataatttcaccctctttgttcagtttgcctgtacagacggagtggtatatcctaacattgttttgaaatataaatcagaataaaaaatgaccgtttgtttacaatcgtttttctaaaaaaaactcccgacagaatttaatcctatcgggagttttttatgcttattcgtccggcgaatggctttcggtttaaaatggcagatcgtctttggcatcccccggagtaaattccggcatagctgacggaggtgggggaggaacgggagaaccggaagccatcggagcacctgcaccaacacgttctactttccatgcacggatactattgaaccaacgatcgttccactgacgggcgtcaacgtcgaatgatacagttagttcttcgcccatttgaatgttgaactgctcaattttgtctgcgccaaatacgtcgaagcacatcttgcgcggatattggtcgtggttttcgataacgtactcttgtgatttccactcgttgccgctagtttttgaaactccgcctctcggggggaggatagcgatgatttttcctgtaaattccattgcgataattttaaattctggggcgaagttacaattttttagtaatatccctcacacaatgcctgtttttttcttttgttttattgggcagcccaaatcttttttcgtaactttgtgcgatagaacatttaaaacttaaatacacgaaaatatatgaaatttatcgtttcaagtactgctctttccagccatttacaggccatcagccgtgtgattaattcaaaaaatgcgctgccaattctcgattgtttcctcttcgaattggaagacggaacattgtctgtgactgtatccgacagtgaaacaacgatggtgactaccgtagaagtgaatgaaagcgatacaaacgggcgttttgccgtagtagcgaaaacattgcttgatgcactgaaagaaatcccggaacaaccacttacatttgaaatcaatccggataattatgaaataacagtgcagtaccagaacggaaaatacagcctgatggggcagaatgcggatgaattcccgcaatcggctacactgggtgataatgcagtccgtgtagaaatggaggcaagtgtacttctgggaggtatcaaccgttcggtatttgctactgccgatgacgaacttcgtccggtgatgaacggtatttatttcgatattaccacagaagacatcacaatggttgcttcagacggtcataaactggtgcgttgcaagacattggcagctaaaggtaacgagcgtgcagccttcatccttccaaagaaaccggctactttgcttaagaatcttttgccgaaagaacaaggcacagtgacgatcgaattcgatgaacgcaatgctgtattcatgctcgaaagctaccggatggtttgccgcctgattgaaggacgttacccgaactacaactcggtaattccgcagaacaacccgcacaaagtgaccgtagaccgtcaacagttggtaggagctttgcgtcgtgtgtctattttctcgtcgcaggcaagcagtttgattaaactccgtatgcaggaaaaccagattgtgatttccgcacaagatattgacttctctacttctgccgaagaaacacaagtttgccagtatgcaggtgcagcaatgagcatcggtttcaaatcgacattcctcatcgatatcctgaacaatatttcagcagacgaagtagtcatcgaactcgcagatccttcacgtgccggagtaatcatcccggtagagcaggaagaaaacgaagacctgctgatgctgctgatgccgatgatgctaaatgattaatagtaatcaccgcaaaataacacagagttctacagagcaataaatacataaaacactctgtggaactctgtgttactctgtggtggaaaaaataattagaaatgaaattaaacctgaaaaatcccattgttttttttgatttagaaacaaccggaaccaatatcaacacagaccgaattgttgaaatctgctatctgaaagtatatccgaatggaaatgaagaagcaaaaacattacgtatcaatcctgaaatgcatatcccggaagcatcttctgctatacatggcatttatgatgccgacgtagtcgattgccctactttcaaagaagtggcgaaaaacatagccagggacattgaaggttgcgatttggcaggatttaattccaatcgttttgatattcctgtccttgctgaagagttccttcgcgccggagtggacattgatatgacgaaacgcaaatttgtagacgtacaggtgatcttccacaaaatggaacaacgcaccctgtctgctgcctataaattctattgcgacaagaatctggaagatgcacacactgccgaagcagatacacgggccacttacgaagtgctgaaagcacagctcgaccgttactccgatcttcagaatgatattgcgttcctggcagattattcaagtttcagcaagaatgtagactttgccggacgcatggtgtacgatgataatggggtggaagtgttcaacttcggaaaatataaaggaatgtctgtagccgaggttttgaagaaagatcccggatattacagttggattttgaatagtgatttcacgttgaacactaaggcggcattgacaaaaatccgtttgcgtgaaatgagtaatttgattacaaaataatgctaaaaggaaaaaaaataattcttggaattaccggcagtattgccgcgtacaaggcgtgctatatcattcgcggactgataaaacagggagcggaagtgcaagtcgtaattactccggcgggaaaagaatttattactcccatcactctttcggctttgaccagcaaaccggtcatcagtgagttttttgcccagcgtgacggaacgtggaatagccacgtcgatctcggattgtgggcggatgctgtattgattgcacctgccactgcctctactatcggtaaaatggccaatggaatagccgacaatatgctcataacaacttatctttcggcaaaagctcccgtgtttgttgctccggcaatggatctcgatatgtttgcccatcctgccacccagaaaaatctggatatcctgcgttcttacggtaatcacattatcgagccgggaacaggagaattagccagccacttggtaggaaagggacgtatggaagagccggaaaacatcatccgggtattggatgaattcttcgcttcgagtgatgaactatccggaaagaaagtgatgattacagccggacctacttacgaaaaaattgacccggtgcgtttcataggcaattattcttccggaaagatgggatttgcgttggcagaagaatgtgcccgtcgcggagcgcaggtgacattgataacaggtcctgtgcagctcaaaacgaaacattcccgtatccggcgtgtagatgtggaatcagcagaagaaatgtatgcggcttcacagatctattttccagatgctgatgcaggtattctttgtgcggcagtagccgactaccgtccggaaacagtggccgacaagaagattaagcgggagaaagaagaggaactaaccctccatcttcaggcaacacaagacatcgctgccaatttaggagcactgaaagggaaaaatcagttattggttggctttgccctcgaaaccaataatgagcagcagaatgccgaaggaaagctcgaacgcaaaaacttcgactttattgtgctcaattcgttgaatgatgctggagccggttttcgccatgataccaataaaataagtatcattgacaggaaaggtcgtacagactatcctctgaagccgaagacggaagtagcccaagacatcatcgaccgtctggtagccaccctgtctcccggtttttaatttttaatctttaattaaaatagaaggtgttacgttcactatacattcagaattacgcattgatagaaaaactggatatcagttttgaaacaggcttttccgttataacaggtgaaacgggagccggaaaatcaattattctgggagctatcggactcctgttaggacagcgtgccgatgtgaaagcgattcgccacggagcttccaaatgtatcatagaggcacgtttcgatatatctgcctatggtatgcgtccgtttttcgaagaaaacgagttggaatatgatgaagagtgcattttgcgtcgtgaagtgcagtcttccggtaagagccgggcattcatcaacgatactcctgcttcgttggcacaagtgaaagagctgggcgaacagctgatagatgtacattcgcaacatcagaatctgctgcttaataaagaaggatttcagttgaatgtgcttgatattctggcgcataatgacgctgcattggcgaaatatcatctgtgttatgacgaatggaaacagacagatcgcgaactcgctgaattagtgtcactggcagagaaaagtcgctccgatgaagattatatccgcttccaactcgaacagctcgaagaagcctgtttggtggaaggcgaacaggaagaactggagcaggaagctgaaacattaagtcatgcagaagagataaaagccggactttaccgggtggagcagtcgtttgcttcggatgaaggtggcttgctttcttatctgaaagacagtctgaatacactgaataatctgcaaagagtatatcagccggccaaggaacttaccgaacgtatggagagcgcttatatcgaactgaaagatatttcgcacgaagtctctttacaaagtgactccgttgaattcaatccggttcgtctggacgaagtgaatgaacggttgaatctgatttattccttacagcagaaacatcgggtacaaacccttgatgaattgatagcgctaacggatgaataccgcagcaaattgtcggacatcacttcctatgatgagcgtatcgccgaactgactgctcgcaaagaggaacaatataaacaagtgaaacaacaggcagaagtgctgaccaaagcccgtacgaaagctgctcgtgaagtagaaaaacagctggctgtccggttgattccattaggaatgccgaatgttcgtttccagatagaaatgggactgaagaaagagccgggattgcaaggagaagatacagtcaacttcctgttttccgccaataagaacggcaccttgcagaatatctcttctgtagcttcaggaggtgaaatcgcccgtgtcatgctttctatcaaggcgatgattgccggagccgtcaagctgccgactatcgtatttgatgaaatagataccggagtctccggtgaaatagccgaccgtatggcggacatgatgcaggagatgggcgaccgcaaccgtcaggtaatcagtatcacccacctgccgcagattgctgcccgtgggcgtgctcattataaggtatacaagaaagatagcgatacggaaactaacagccatatccgccgtctcactgacgaagaacgggtagaggaaatagctcacatgcttagtggtgccactctcaccgaagctgcccttagcaatgccaaatccctgcttgcccgcaactgataaatagtgaatagtaaatagtaaaatagtaaatcaaccagatgttagataaaagtgaaatgattttcggcgttcgtgccgtgatagaagcccttcaggctggaaaagagatagataagatcctcgtgaagaaagatattcaaagtgatctttccaaggagctttttgcagctttgaaaggtacgctgatacctgttcagcgtgttccggtagagcgtatcaaccgtattacccggaaaaatcatcaaggagtgatcgccttcatttcttctgtgacttatcagaaagcggaggatcttgttcctttcttgtttgagcaaggaaaaaatccgttttttgttatgctcgacggagtgaccgatgtacgcaatttcggggcgattgcacgtacctgcgaatgtgcggctgtcgatgctgtgattattcctgtccggggtagtgcgtcggtcaatgctgacgccgtgaaaacatcggcaggagcgctacatactcttccggtatgccgtgaacagaacctccgttcgactctgcaatatctgaaagatagtggtttccgcattgtggctgctaccgaaaaaggagattatgactataccaaggccgattatacaggtcccctctgcatcataatgggagcggaggatacaggagtttcttatgaaaaccttgccctctgtgatgaatgggtgaaaattccgatgctgggcactatcgaatccctgaatgtctctgtagctgccggtatcctgatttacgaagctgtgaaacaaagaaacaatgactgatatgaagaagattttaattctacctttgctgcttttcttcctggtacaaggaagcatggcacaaaccccaaaatgggtagagaaggcaaaacgtgcagtcttctcaatagtgacttatgacaagaatgataaaatgctgaatacgggaaacggattctttgtgtccgaagacggattggctttatcagattatactctttttaaaggagccgaacgtgcggtagtgattacttccgaaggcaagcagatgccggtcagcctgatacttggagcgaatgacatgtatgatgtcattaagtttcgtgtggctatcaccgagaagaaagtgcctgcactgatcgttgccaaaacagccccggtgacaggagccgatgcatggatgcttccttattctacacaaaaaagtattgcttgcgttactggtaaggtgaaagatgtttccaaagtagccggagaataccattattatacattgagcatgcatatgaaagataagatggtgagctgtccggtgatgaatgcggaaggtcaggtatttggtattgcgcagaaatcatccggtatcgatacggtgactacttgttatgcggcgggagcagcttttgccatgtcgcagaaaatcagtgctctttctttgggagacgctgccttgaaaagcattggtatccggaaaggtttacccgaaacggaagatcaggcattagtgtatctgttcatggcctcttcgagcctctcgggcgaggactatgaaaagctgttggatgacttcattcgccagttccctgccaatgcagatggttatctccgtcgtgccaattattatgcatctaaaggtaaagacgatcagacctggtatgataaagccgttgccgactttaatcaggctctgaaagtagcccagaagaaagatgatgtatattataatataggtaagctaatgtatgcttatcaattatcgaagccggagaaaacttataaagactggacgtatgacactgctttgaagaatgtccgtcaggcaatcgctattgatccgctgccaatttacattcaaatggaaggcgatatactgtttgcccaacaagactatgccggtgctttggctgcttatgaaaaggtaaataccagcaatattgcttctccggccactttctttagtgctgccaagacgaaagaactgctgaaaggggatccgaaagaagtggtagccttaatggatagctgtattgcccgttgcccgcaaccgattacggtcgactttgctccatatttgttggaacgtgcgcagatgaatatgaatgccgatcaggcgcgaaatgcaatgctcgattatgatgcttaccatacggcagtcaagggagaagtaaacgacgtgttctattattatcgcgaacaggcagctttgaaagcacgtcagtttcaacgcgctttagacgatattgccaaggccatcgagatgaatccgacagacctcacctaccaggcagagcatgcagttgtaaacctccgtgtaggacggtatgaagaagccattcagattttaaataatatattgaagactgatcctaaatatggtgaggcttaccgtttattgggactttgccagatacagctgaagaagacagatgaagcttgcggcaactttaagaaagcgaaagaattgggtgatccgaatgcagatgaattgataaccaaatactgcaagtaaaaagatcatcttcttgaagataaaaaatgaatccctgccaactcgaaaattggcagggattcctcgtttttggggacgttgtataaaaaactctctctctctttttatttttccccacttcacttgttaagttcaggttgtaggttttaatgatatatggtttgatttccctttttcccctcttttataagttaaatgcatggttattgaaaatactgcatgacttcacttattttttttagaaataatttgaatttctatctaaaacagtaagtaaatttaaaatcgtggttcattttatctataatcttactatattccgcacgtttttaataacacgtatgagataagttataatttatggaaaaaaatcgatttactatttgtgcaaacaattacatcgactgtttgcgacaagaggggcgttattctacggcccatgtgtataaacacgctattcgttctttttcgcagttttgtggaactcaatccatcacgtttagtaagataaaccgtgaaactctaaagaggtatagtaactatctgatggcttcccgtttgaagcccaatacgatttctacgtatatgcgtatgttgcgtagtatctacaatcgtggtgtcgatatgcatcaggctccttatgtacatggtttgttccgggatgtttttaccggggtggacacacgtcagaagaaagctatcccgatcggcgaacttcacatgctattaaacaaagatcctcaatcggaaaagcttcgccggacgcaggccattgccaatctgttatttcagttttgtggaatgcctttttctgatttagcccatttggaaaagtccaatctggagcgggggcttttgaagtacaatcgtaccaagaccggtactcctatgagtatagaagtgctggagtcagcgcagaatgcaattgggggattgtacaataaatctgacgcccggagttctggctatcctgattatcttttccggatattaagcggagcgtacaagcggaatgaagaaggagcctatcgtgagtatcagtcagctttgagacgttttaataatgagttgaaaagcctgtccagaaaattaaggctacattcgcccgtcacgtcgtatacgcttcgtcattcttgggctacgactgctaagtacagaggtgtacctatcgaaatgattagcgaatcactaggacacaaatctattaaaacaacacagatatatttaaagggtttcgaattggaagaaagaacaaaagtaaataaattgaattattcttacgtttgcaattttaaaatgctctgatttatattattaaggcattatggattagggacttaatgctggtgttacttcttaggtaacggaattatattcgctacaaagataggtaaaaatattaatagcaaacaaacaataaacttctttttttcctttttctctaaaatatgcaacataaatctatctgaacatgaaggataacatcttcatgctcaaaggctttttattacctaaattcaagaatgttttatattgaatgttaggtgcccgcttttatattccctcataatcgatttttttcttttttcacagcgatgtgtattctatatgtgtgttgtccgttacctaagaagtaacggatgaacatggggtaaaaaaatatgattttaacgaaaccgaaatcagtaaatgccgggcctagtagtgggacaggggaaggcgtagcacactcaaaacgctggtatgtagcactcgttcgaatgcatcacgagaaaaaagttgccgagcgtttgtctaagatgggaattgattcttttgttcccgttcaacaacaaatccatcaatggagcgaccgtcgtaagatggttgatacagtcttactcccaatgatggtttttgtacatgtcaatccaaaagagcgtatggaggtcctttcattttctacggtcagccgttatatggtgatgcgtggagagagcactcctgccgttattcctgacgagcagatggcccgtttccgtttcatgctcgattattccgaagaagcagtctgtatgaatgatactccactagcgcgtggtgagaaagttcgtgtcataaaaggtcctttgagtggacttgttggcgaacttgtgactgtaggcgggaagagtaagattgccgttcgtttaaatatgcttggctgtgcttgtgtagatatgccaatcggttatgtagaatccacaaaaatcaccaatgacaacacgaagaaaatttaacgtatttctattcattctgttgctgggagttttttctcctttaatggctcaaaatatgagcgactcccaagttcttgaatatgtaaaggatggcatccgccagggtaaagaacagaaacaactagcctctgaactggcacgtagaggtgtgaccaaagaacaggcaactcgtgtgaagcaactgtatgaacaacaaaacaatgttaatgcttccaatgcaacgggtaccgatgtcaatgaatcacgtcttcgtgaggaaatgaaagaaaacacttccgatatgctggaagaccacccgagcactcaagacctcgcacgtggcaatcaggttttcggacgaaatattttcaacacccgtaacctgacttttgaacccagcgtcaacatcgccactcccttgaactatcgtctgggtcccggtgatgaagtgattatcgatatctggggagccagccagaacactatccgccaacagatttctcctgacggcacgatcaacattcagaaaataggtcctgtcaacctgaacggactaactattgctgaagccaatgactatctcaaaaagacattaaacaagatatataatggtcttaataatgcgaatgatcccacctctgacatccgtctgactttgggcagcatacgtactatccagatcaatgtaatgggtgaggttgtccaaccgggtacttactccctctcttcttttgctacagtcttccatgcactttaccgtgcgggtggagtcagtgacataggaagccttcgcaatgtacagctggtacgtaacggcaaaaatatcgccacgatcgacgtctaccaatttatcatgaaaggaaacattcaggatgacatccgtcttcaggaaggcgatgtagtaatagtccctgcctatgacgtattggttaagatcgacggaaaagtgaaacgccccatgcgtttcgaaatgaaaaaggatgagagtctatccactcttatcagctatgccggtggctttgaagccgacgcctacacccgttccttacgtgtcgtacgccagaacggacaggaatatgaagtaaacacagtcaaagaccttgactatagtgtctataaaatgcgaaacggtgatgttgtgaccgccgaagccatccttaaccgcttcatcaacaaacttgaaatccgcggagccgtttatcgtcccggcatctaccagttgaatggaaaactgaatacagtccgtgaactggtaaacgaagctcaaggcctgaccggtgatgccttcttgaaccgtgccgttctctaccgccagcgtgaggacttgactaccgaagttgttccagtagacattaaagccatcatggacggtacttcccaaaacatcatcctgatgaaaaacgacatcctttatattcctagtattcatgacctggaagacagaggcaacgtcgtaatccacggtgaagtagccaaacctgattcttatccttatgctgataacatgacccttgaagacttgatcattcaggcaggtggattgcgtgaagccgcttctgtagtccgtgtagatgtatcccgtagaattaagaatcctcgtagtacagtgaataatgatactatcggccagatatatacattctccctaaaagaaggttttattgtagatggaactcccggctttgtccttcaaccttacgatgaagtttatgtacgtcgtagtccgggttatcaggcccaacagaatgtggttgttgaaggtgaaattctgttcggaggctcttatgcaatgaccagccgtgaagaacgtctttcggacttgatcaataaagctggaggtgcaacgaattatgcctacttacgtggtgcaaagttaacccgtgtagccaatgcaagtgaaaagaaacgcatgagtgatgtgatccgcttgatgagcaggcagttgggtgaggctatgatggactctttgggtgttcgtgtggaagatacctttagtgttggtattgacttggagaaagcattagcgaatcctggaagtacagcagatattgtcttgcgtgaaggtgatgtgatttctattccgaaaaataataatacggttacaatcaatggtgccgtaatggttccgaatactgtttcttatatggaaggaaagaatatagactattatctgaatcaagccggtggttattctgaaaatgcgaagaagagtaagaaatttatcgtatacatgaatggccaagtgactaaagtgaaaggtagcggtaagaaacagatcgagccgggatgtgagataattgtacctagtaaggctaagaaaaggactaatattggaaatatcttaggttatgctactacattcagcactttgggaatgatggttgcatctattgctaatctgataaagaaataaaagaaaacagcttataccattatgatagaaggggaatctgaaaaagaaataaaacaggggcagagtaaccatatagataaagagaccgaaattgatttgatggatgttcttcgtaagattatagctattcgtaagacaatttataaagctgctggtattggtttggtaattggtgttattatagcaatttgtattccaaagcaatatacagctgaagtcaccctttctccggagatgggtagcaataagggtggtggtctatctggtttggcagcttcttttttaggaagtgacgttgccatgggagatggtactgatgctttgaatgcttctttgtctgctgatattgtttcttctactccttttttattagaactttctacaatggaaatacctgcatcgaaaggtgagaacatgactttgagcacttacctagatgaagaatatatcccttggtggagctatgtaatcggatttccaagtataataattgatggagcaaagtctttgtttatcgaagaagatgaattagtatcttctaatagaacaaatcaaggtataattgaattatctaaaaaggagtcgaagaagattgaagttttaaagaaaatgattactgctattgtagataagaaaacatccatgactacagttgctgtaactttgcaaaatcctaaagttgccgcagtggtcgctgattctgttgtgaagaagttgcaggagtatattatagactatcgtactaccaaggctaaagaggattgtatttatttagagaaactatttaaagagcgccaacaagaatattatgcagcccaaaaagaatatgctaattatatagattctcacgataatattatcttgcaaagtgttcgtgccgaacaggaacgtttacagaatgatatgagtttggcttaccaagtgtatagccaggtggcgaatcaacttcaagttgccagagctaaagttcaagaagagaagcctgtgtttgcagttgtagaacctgcggtagtgccattggaaccttcaggggccagtaaaaaagtatacgttttggtgtttgttttcctgtctgtttgccttgttgtgttttggaagttatttggggatgattttctgaataaaattaaagaaatacgagcttaattttcattagtaaagtaatatggcgtcaactaaccaaataaataaagtagtagaacttattgcagtcttgggagatttgattatcctcaactttagcttgtttttactacttttctattggaaaaacgtattcatgtattctgctttttcttgtaccacttctttgatgatgacttcgcttagcctttgttatttagcatgctctgcatctcgtggaaaagcttggagtagtagggaaattcgtgcagatcagcttgttttgcgtgtgttgagaaatgttataactttttctatcttttgggcatgtatcatgacttttagtgggatctccatattctcccctcttttttttgttgtttatttttttattctctttgtcgttttaagtatctatcgtatcattattcgtcattcgttgattatttattgtgctaagggtaaacataaacgttatgctgtttttataggtggaggtaataatatgcaaatgttatttgaggaaatggaggggtctttagcatctatttatgaagtagtaggttattttgatattgtacctaatgacattttttcatcccaatgtccttatttgggaagtcctgacagctttgctgattttatgtctggaaaaacgtctataaagcatgtgttttgttcattgtcaatggagcaaggacgatataatttctctattatgaattattgtgagaatcatctgctttattttcatggtgttcctaatgtttgcaaaggttttccccgacgtatctggcatagtatggtaggcaatatgccgattctaaatttgcggtatgaacctcttagcaagatggagaatcgtatcttaaaacggatatttgatattgttttatctggtatttttttgattacaatttttccttttgtttttctcattgtgggaagtattataaagttaacttctccagggcctatactttttaaacaaatgcgaacaggtttgaatggtgtagatttcttgtgttacaaattccgttcaatgaaagtaaacgatgaagctgatagtaagcaggcgacaattgatgatcctcggaaaactcggtttggagactttcttagacgctctaatattgatgaatttcctcagtttataaatgtctttaaaggtgaaatgtcaatagttggacctcgtcctcatatgttgtctcatacggagacttatgcccaactgatcgataaatatatggtgaggcatttcattaaaccaggagtgaccggatgggcacaaacacatggttttcgtggtgaaacaagagagctttcacagatggaggagcgggttaaagctgatatttggtatatggagcattggacaatattgcttgatttatatattatttataagactatagtgaatgtggttgttggagaaaagaatgcatattgagaaaaaaaattaaaggtaaattatagacagaagcctttaatgaaaatatttagagatcatttataggtttgaattttattataatgcgtctttagttatatagaaagtaatttggtaaatataaaaaaaatgaaaaagaaaatctctgcaattattcctgttaaggctaatagttctcgtcttccaggaaagaacattttaccttttggtaaatcaaatcttttgctccataaaatagagcaattaaaacaagttgaagatttatatgagattatagtctcgtcggattctgatacgatgttggaaatagcagaaaaagctggagtgaaagctattaaacgtccggggcaatatgcaaatgagtccgttccttttggctgttttttagattatgtttgtgatatttgtagtggtgaccatattatgtgggcatgtgctacttctcctttggtagaaccttcactttatcgtaaggctatcaagacttactttgaaaaacttgaagaaggatatgattctcttataacttgccttccatatcaacatttcttaatggatgagaatggacctattaattttgagataggcttaaaacatacgaattctgaaaaactgcctataatatatcattttactaatggggtaaatttagcaccgaaagaaaaagttcgtgagtggcattataattgggggcctaaagctttcaaacttttggtgaataaacgagaagctgcagatatagacgatatttatgatttggctcaagcaaaagcaatgttagatttgagtactcttgaaaatgaactagagggctggagaaatgaacatctaaaataagaatgacctagcagaagatatttctatcttttgctagattgttttatagttttacattaaaaatataaattaatgaacagtagcattaaacttttagattgcacccttagggatggtgggtacataaacaactgggacttcggatttcaggttatatgtaatgttataagaaaaatggtagaagcggaggttgattatgttgaggttggatttcttagaaactgtgaatattcgaaggataaaactctttttaataatataagtcagttgaaaacagttttacccaagaaacatggtaagacaaagtttgttgctatggctttacacaatctttatgacattaataaattagaagaaaatgatggaactatcgatgccattcgagtaacttttcatgattatgatatagatgaagggctagaatttatatcaaaagcaatgacaaagggatataaggtcttttgtaaccccattaatataatgggatatagtgatgcagaattattgattcttctggaaaaaattaataaggttcatccatatgcattttctattgtagatacatttggatcaatgatggaaaatgatctacttcgcatctattctcttgtagagcataatttggataaagcaataaaaataggattgcatttgcatgaaaatttgggattatcatattcattagcgcaacgttttatagggatgaaatcttcagagagagagtgtgtaattgatgcttcattatgtggaatgggacgggtgccgggtaatcttaatatagagcttatgatggattatatgaatcgttttcagggaggatattataatctaagtcctgtatatgatgctatcaatgattacatagaggatttaaagtctattgaagcatggggatattctacagcttatgcattgtctgcgaaatataatttacatcgtaattatagtgagtatctattgagtaaaggaaagttgagagcaaaggatatcaattttatattggctagtatagctgaaagtaagaaagcagcttatgataaagactatattgagcagctttatcaaaagtatcaaaatgtttctgttgatgattctaaaagtaaagatgccgtaaaagagagattacaaggaaaggagatattagttttagggccaggttcttctcttataactcaaagagctattatttgtcaatatatagaggaaaatcacccttttattatatctgtaaattttgtggggagtgacttctgttctgatttagctttctttacgagtcgacgtaggtatgaccaatatagagatgaactgatgacaaatttgttagttatatcatcaaatctgacaaatgatgttgtagatccttttgctatagttgattattataatttagcatgtgacgagtctgggttgtatgataattctatgataatgttgctaagattattatcatttatcgaaatcagagacgttacagtagcaggtttcgatggttttgataaatctaaacctaattacgcttatgagaaacattataaagataataaacatacagaagacgaaaattgtactatttctaattacatagagaagttttcgtcgaagatgaggatacatttcctcacaaaaacaaaatataaaagatgagaaatttagaatccataagattgattgtacttgatgttgatggtacaatgacagacggtggtatttatattgataataatggtattgaacaaaaaaaatttaatattaaagatggcgctggtattattcttgcagaatctataggaatagaatttatgattttaacaggtcgtaaaagtgcttgtgttgaacaacgggcaaaagagcttaatataaaatatgtttgtcaaggtattcattacaaagttgattatttaaaagattttgctcgaaataaagctcttttagcggaaaatatagcatatattggggatgatctaaacgatttgcctgctatgcattttgtgggggtatcagcatgtccattagatgctgtggatgaagttaagacattttgtgattatgtacttcctgtcaatggtggagaaggtgttgttcgtgcatttgtcaatttattgctaaaatcaataaatagatttgaggaggcacaaacaaatctttttcctattagggattaataatggatcaacggtatactagatttcgcaataatacaatactagttattattggtaatattggttctaaactcatgtctttcattatgcttccattttatacaagatggttgcctattgaaggatatggaactgtagatattattaatatatatgtatcttttctaattggagttgtgacatgtgctatagcagaatcggtctttatatttcctaagggacaacctgttgaaaaacaaaaggaatatttaaattcaggacttctgtttatgattatatcctttgttatcacactttgtgcttttatgttaataaagtttgtatgtgatggtgagaatattcaaaactcttttgttgataacatatggatgatatatagtatattaacaacatctgcattacaacaattagttcaacaatttactagaagtatagataagataaaggtttatagtatagcaggcgttgttttaacaggacttacgatagtcttttcttttatttttattcctagatggggtgttgctgggtatgttgttgcgatgtcgttagctaatgttgcaacggtaatatattctttgatagcttcaaactcatatacgtatctcgaattccgttatgcaaatataatatcgtgtagaaaaatgttgagttattctatgcctttagtccccaataatattatgtggtggcttgtgagtgcattgaatcgtcctgtaatggaaatttatttgggaatggaggctatcggtttatttgctgtagcaaataagttcccctctgttttttccagtgtgtttgctatgtttgcagtttcatggcaaatatcggtgatggaagaatatggaaaagatggttatagccagttttttaacaaagtgtttaggattgttattttattaatgattttggccagttgtctaatttcaatcttaagtccattgattattagtgtttttgcaaatgagaattattatgaaagttggagatttgttccagttttatctctttcttctgtttttatggctatatcaggtatggctgggagtaatttttctgctactaaagaaagtaaatatttcttttattcaagtgtatggggagcgttggcagctgttattgccaatattatatttatccccagaataggtacaatgggagcttgtttatctgtagcattatcctttctggtaatgtcattgagtcgctgcttttattgttggagacatgttaaaataaataatattttaaggattatgcttagtcttgcaggtaatattatcattattatgttaactctatcttctttatacatctcatttaagatagtagggtattgtttattttttatctttatattatatgttaatggagatgtcttaaaacaagtttttaatgtaattaaaaccaaaatatgaaatctgcaataaagaagattatatattgtataaagaaactgctagattttgttttttttctaatattgatacttgttaatggaaagcataagaatgtattaagactgtctaaatgtaaaaaaaataaaatagcaataatagcaactggtccatctcttaaagaagacgtacatattattttagatgaagattataagaaacaaaccgactttctgatgcttaacttttcggcttttgattctttattttttaaattgcgtccacgacactattgccttgctgatcctatgtattttcatagttcatggagagatgaagaggtctttcgtttttttaatctattgaataatcaggtagagtggcctatgacaatatatgtcccagctcaaaatcttaaacagtttgttgaattttctcgtttggttaattctaatataaaggtcttaggtgttaatactattatatataatggatttgaaaagtttaggagtttcttttatcgtgtaggcttatcttctccacctcctcaaacagttacgaatcttgctatatttgttggaattaacacaggatatcagaatatagatttatttggagttgatcatacttttctttcagctttgatggttaatgaaaaaaatcaactttgtcagatgtattctcatagttatgatgaaggagaagtcgaatataaagtggttacaagaacggataataataaaatctggaaagtaggtgaatacataatagcttgtggtaatatgtttctaagccatgatttacttgagaattatgctaaaagcatagattgtcgtattataaataatacaaaatgttcaatgattgatagttatgaacgtaaaaaatagatgattttatatcgttgaactatattatagtgtaatcctcgttttgtattatgattaatattattaaaagattagttagctatataataatacaaattagatattggaataaattgaaatttccaatttcagctagaattggtgtgagatcacattttgaaggagctaatcgtatttatgagaggagttttttttcaggtagtatgggatatggatcgtatatagcagcagcttcttatatagcaggaaaggtgggacgctttacttctattgctcaagaagttaaatgtaatcccggttgccatccttatacttatccctttgccactacatctcctatgttcttttcaactttgaaacagaatggtcattctttttcaagaaagcagttgtatgaagaattgagatatgttgatggaacaggtgatgcagtccatataggcagtgattgttggataggagatagagtttttattgtaggaggagttacaataaatgatggagctgtggtattagcgggggctgtagttactaaagatgttccgccttatgcaattgttggtggaattccagcacggattctgcgctatcgttatgatgaagaaactataaatttcttgttgagtattcactggtgggataatgataaagaatggtttttaaaacattgggagttgctttctgatattgataagttgaaggcatattatgtttcatcaaagaactgttaaaacagaatgttgaaaactgttgatcaaaaaggtaaataccagaaacaccgttatagttaatgaagatcaaaggcatatatgactgaaattagaaaaaatattatttctgtgataactgtatgttacaatgctaaaagtaacttggaaaaaaccatactttctgtgcttaatcagacatatagtaatatagagtatatcataattgacggaggtagtacagatggaacaattgatattataaaaaggtatgatgataagataacctattggcaaagtgaacctgataatgggatttatgatgcaatgaataaaggaatacagaaagctaatggtgagtggataaactttatgaatgctggggatttgtttgcatctacaatgattttgcaacaaatgttagatgcaataaagcctggagttcgtattttgcgtgggaatattataagaatataccctaaattcagggtgaaatctgttggtgttactgcacagaatccgagtcttatggatatgtttgataatacctttcatcatcaggcctgtttcatacaaacttccttatttagagagtttggcttatattcaattgattatagattatgttcggattggaagttcttttttgactgtgttgtacttcataatataaaatcccaatatgttgatttgacagtagcctattttaaaatggatggaacaagtactaacaattctattttatatcggaaagaacaagaaaactacctgaagaatttatatggagttgagcaatttgatttattgcatgaattgacaatatatagaaagtcgcgagtgataaccttctattataaaatgtattgttttataatggatcatttgtcgcaacaaaattttagtcggttgcttatgctaaaaagattcgtatggagggttttgaggcgaaatgttaattagctgttgtctcattttttttgagttaaaaataataaagcaatgattcctaaaaaaattcattactgttggttgagtaatgatgttatgcctgaaaaacttcaacgttgtattgaaagttggaaaattaaccttcctgactatgaaatcataaaatgggatttgacaaaatttccattggaaaaaaacatttgggttagacaagcttatgaaaggaaaaagtatgcttttgctgctgactatattcgaatatatgctcttgtaacagaaggtggtatatatcttgatagtgatgtagaggtcttgaaaccttttgatgacttactgcatcttccattttttatatgtaaggaaaatagtcctcaaggtattgaagctgcaacaataggagcagaggctgggacttcttggctgataaaatgccttgagtattataatgagaggacatttattgataatagaggaaaggagcaaacggtggtgttaccatcaattcttaaggattgtattactcgggattttgatatttgttatattgatagtcctttagaatttaaagtaaaagaaaatacggtttgcgtgttgccgatggattatttcagtcctaaaaactatgtaacgaaaaaaatagttgttacaggtaatacttattcaattcatcattttgcagggacttggcaacctatttggaaaaaaactctgctttatttatgggttccgttatctgtaaaatttcctcatttggctgcatggttaaagcagaaaattggctgctaaaatttatttgattaacgaaatatcgcgtagtactgaaagattgtattaatagaaaattgctaaaatgaaaataagtgctagtgaattggcatttcttgtgtactttctgccattatttgcattaaaaatgcttgatattactgctgataataatttgttgaagataacagcaggcggttgttttatattgtttgccatgtatatgttttacatgaagttcagtaatcgcttattgaaattttttcttttattattgatttatacggtaatactcatttttacttgtggtaaacagggggcatttttttctgttgtgatgctattagctatgaaagatgttaatatggataataaaaattataaaatctgtttttgggtcggagttgttttttttattgttgcatgttacttaaataaggatggggcagaagctgtacggtttatgaatggggaatgggtgaatatgaataaacgtagtaacatattatatgttgctttcactgctttagtttgtttgtaccttttgaaatatagagatagattaaataatatgcgaatattaggtgtcgtcattgttaactatctgatatatctgtatgtgggttcaagaacaggggttatttcaattatatttctcgtggttatgattttattatttagaagccagcgttttaggagaatgaaaatcattaagtatggatgtgttttttctcctcttatttgtatgatattttctattgttgcgggggtgaagtatgatgaatatagctttcttaaaatattagatatgatgttacaaggcagaattgcccagaataatgcttatttagacaggtatgacataaagctatttggacaacatatatatgagggagctgaaaatggtgatttttggaacttggattgtgcatatcttgatatgttaatttgtgagggattgatttttgcagtattatggattgttgttagtactgcgctaataaagtatatgtataataataataggatggttgaggtagctatattggttatgtatgctatctatggaataagtgaaacttttcttttgaattgctttttgaatatgtctctatttttatacggggagtacttatatatacagtttaataaaatccctaatcctatccgatgttaagtatcgttttaatctatatagatttattgttattccaccatgataagtagatctgtattaattagaaaaataatttcaacagaagattttcttcttaatgaaatatttgagaggcaggggcagatatatacttttttgaaccctgtgtcatatttgtttgcattagaaaataaagaattatttggtcgatttgatggtatttttgctgatggctcaatattggttttagccatacgtttactatatggtaaacgagtaacaagacgtagttttgatatgacatctattgttcctaagttactagattatgcggttgagaatgataaaactatttatatagtggcttctaagcaagttgcaacagagagagctgttgaaataattagaaaatgctatcctgcagtgcggattattggttatagaaacgggtatttttcttcagaagaagagatgagaatagaagcagagcatattgtagaattaaatccagactttttaatcgtaggtatgggagtattgatgcaagaggactttttatatagagtaaagaggaacggatatttaggtatcggttttacgtgtggtggctttattcatcaaacatctaaaaatgaaataaattattatccaagatgggtagataaaatgaatatgcgattcatctatagaatctgtaaggaaaaacatactcgtaaaaggtacttattggcagctttcttgttcccactaagatttattgaggaaagagttttcgggcagagatatgataaacagctttgtcatcagaatgagaaatagagactatattgaaataataatggaatattatttctattaaaattgctgaaattattccattttaatattttaatgagatagtgataagaaatggtataaaataaaatgttgaggtgtaataaacacgtgagtgtttcgtatgtgagatgaaaaaaatgtaggtccctagcttcatgctgtaaaggcatgattctcctacattgtggattggaaatcgtacgacggtacatttctgatctacgccctgacatcggaggttaaagccgatgtgaatttcccactatatcaactgtctgtgaagatcgttgatatttctttttattctcattatactggataataatatcagttttctttgtttatatgttgaaatatttgtaactttatagcatagaaaacagtaataaagaaacgatggaacattcagactttgtagtgaaatgttataataaacaagagttagcccagatgtattttcctgatctgacgattcgtgcttcggtcaataaacttcggaggtggatgaggagatgcaagccgttgatgaatgaaatactatctactgactttcatccgaagacaaaggcattttctgtgagagaagtgcggcttattacctattacttgggaaagccgggggaactgtaaatgatataaacataaaaaagaactacgggagactgcactttcgcgagctcccgtagttctttttatatattcatatactcttttcgactgtcaaaacagggacaagccttatgaatcgaagcactaagttgataatgtcccaggatttgcgcatccggatattgatgtttgagaatcgtcaacaagtcaagtagcgcgaagcgctgcgcctgtgttctcgtatccgccggacgaccttcttcatccaacccaccttcatagcaaattccaatactatgccggttgaaacctcgcacatgcgcaccgggctccgataccgggcgacaatggtgaagttctccattacgggtgatgtaaaaatgataccctatatccttgaaacctcgttgcaggtgacattgtcgaagctgctttacggtgaaggaaccattgcagcgcgtcgcgctgcaatgaatcaccaacaacttaatctcacgtgggagatagttttcttctgaattttccatatcggtcagcaggagattaatgtcccacgcaggacgttacaccgatagccgaaatgatcgaagtcgcgatagttacgataaactggagaatgtttttccaaagttgctttttcatataaatttgaattaaagaataaatactactgatacattatgaactcaagaaccagtcaacaaccggttgattatgctgccgggtccggagcttccccgctgccggaacctccctgattatcatcaccgccatcatcaggaagcggatctttatccaaatcagtggaagaatcactcttatacagtgtataatccaacgtcttacacaacttgcggagatcactacccggataaaagagcactttgcccttatcaatgcacgatgccttgaattcctttgctgtatcggtaggagtaccggtcttgatactcatacgaaaattacccaggtcacccatttggacgatatttccttcatccagtacattgacgatttcgagtaaaaactcaccgatacaaccttctagttcccctttggagtaagaagaacgttcagtgatacgtttacaaacttctttgaccgttactttacgaccactacgcgccactgcatagtacttgggagtttcattaggtttcaacaggttcttacgagccataagagtgtaattctgtgccataacttttaattttaaatcattaatttttaattgtttaattgccttgtaatcgattacatgacaaaagtactacatcgggaaagcggcatgacgcataatgacgcacacagacgcacagataaaaagaaaaaacatcgggagatttgtatcgaaacttcccaatgtttgatttcaatcattgagatgtttttttcaaatctcccgatgtttttccggactcttcaaaaggacaaaaggacaaaaaggacagatgtgactattgctcattcatcttggtataagaaccatgggatatcttattgatttttactccattaagcgattttagcagacgtgttactttacgatggttgaaatcatattttgcgccaatctgaatcgcttcatctgttgtgaaactgtcgggcaactcttgaacgaaattacgaatagtgtccggattcttcagtggacggaccgaaggagacggcatggatgagtgcaacagccggctatgttcgtaacaacatagaacgatttgaagagaacgctcaaaatcagcgtccgtgcaataaatctcgggagaaagatcggttgcctcaaattgccggatacgggtctggatcatactgatacgcatcaccagaaaagcatagcgtttcactacggcttggaggtcatcgttgccttccaatgccacctcggacagcatacgtgagaaaatctcattcagacggttccattgcaggcggttgaaatgaaaaagaaccggatgagccagacagaagtgatataattcggagacacgatgcgcaatcggtttgaaagaatcttccagtgagacgcagtcgtcgcccatttctttccagtgcggagcttcgcggaaagtgtaaatcagggtgcggctgggcaatccgttttcgtagctgctcaataggccgtctatttgtccgggagtacctgtcagcaacaaagccaatttgggatggcgtatatagatcggaatgaggccgttggctttgtaggaagaatctatattttcgtgctcaaaagccttgcggagcatatcgtcgaaattgccacaatccagatgattggctgtggatagcgtttgtgcctccgtgtcgaaaatgatgcttccctgtggaccgttgtcctgcatctgcatttgcatgcgggtatagctggtagtagcaggaatgaatagcattttgaaaggaggtcgttgcggttcttcggagcatgcttctcctttctttttctgtttttgatattctgattgccagttattatgtacagtctggtagtttttcatcatagattcactggtagacaggatttctgaatgtatttcttccaacaggtatcgtccggtttgggcgatgcttttaccactggcggcaggcgaaagtatgacactgaatatatgcgtggagtattttttatgattataaattccgaaagtctgcggaagtgctgcgctcaaggccgtgagatcggaaaggagagcgacatcttgttcgcgttcgcttccgtcttcaatgatacagtcatttaataggtcgggaagattattgtacaaactgcggggaaataaaggagttccttttcggaattcttctcccagccaataggcttcgtcgtcggtatcggaattttctgcagtactatattgtctttttgtccttatgtccttttgaaaagaaggggcgctggccggagaggaagcgggtgcatgttcattaacttgtttatatccagacgataaaacctttgttagttcttcgggacgaaaatccgtgtgctcgaaaaatacagtaagttcgcgtaatatgcttttctggggatagtgtcggcggcaggcttcgcaggcaagtttgaagacgttggaatggcgctgaccggctgttagcggatgaaagaaaatataggacgaaataaattgggcgatttcttcttcagacacgttttccggagtattattctgaaggggaaagggaggaagcacttcattttcagagaaagtgtttgtttcttcttttataagtggctccaacacaaatgcctgatagagcgccgcaacatatccgttgggggaataactgaaataacacaggcgactttcgtccttgcatgccgggtcactctccaatcccagcagttgattgtagtagtggctcactagttgctgcccttcacgatggcggttttcgataccttctacataggcgaaaactttcactccgtcggtagggctttctattgccgctactgtgtggggatctgccgcacaacgttggatgacttgaagacgatcttttacatgatcgtaatcaagtccgacaatatggctggggagaagaaagtttttgatagcgtgcgctccgtcgaatgtgcctgccggagtgaagcaggggagttggtttttcagcttctgtgccgcggcatggtctccttctgcatagtaccgccgaatagcgtttatgatggaggcatagatcggatgaatgcacataataatgacttcaaggaaagacatgactcggggcttttttgaatacacattttcgtaaaccgagactttgatttcttctaaaactttcatataaaattgtttttgtaagattgagctacctgactatcagataacgggaacaaaggtcgggatattaaaaatagggttgcttccctatgtggatagcacttgataaagcaaataaaaaatgaaatattataatttattaatcatagaatgacatggcaaaagaaaaacaggaaccttatgagtttttaagcaatttggtattggctttaatggatatggatcgtattttcagtaacagttttttcataagcgaattcgctatctctcctaaaacattaggggagataaggcggggagaggatatgtgcatttatcagtatgtacgggtgatccggtgtatgacgaaatatcttcatttgattattcagctggatatgttgctgaaggagttaagaatcgtactgtcttcccattgtgacttggtggtcgctacggttccgcatcgttcttgcggaacttgtcagccgacagaatgggtggcagtgatgcattgggatggagtgaaattgtgatttctacagaaaatagggcattttttcaatctttttgcccgatttctttctttatttaattttttttatatctttgctttcatattgagaaacacggataaaaactcacttatttattcatataaatttaataaattatgttcaaagctcctttctcatttgacgggcgtattcgtagaattgaatatttcctgtcgggcattatcggtggtatagtttccagtattgcatgggcacttggtgtaggtacatttattttgggtgctgccagcggatcggccggtggatcagtatttggtttattgatcggtcttgctgctatgattgcttccatttggttctctttggcacagggtgtgaaacgtctgcacgacttaaacaaatccggttggctgattttgttgtgctgtgtgcctatcattggttggatttttgcattgtatatgttgtttgcagatggtacggtaggtcctaatccttacggagcagatccgaaaaaccgtatgccatatcaggcacagcctgcttctgtaaatgtgactgtaaacgtttcaagagaagaggtgaaagttgacaagccggtggaggatgctcccgcacctgcagaagctccagcggaggagaataaagaaaaagctgaataatcttattaaagaagaaataagaaagcctcttgcaaaattcgttttgcaggaggttttttgttactaatctgtttgttattcaatattttgtataaatttgtagaataaataatcaatctatcgaatatgtatatgttaagcacagtaatctctcaaactggtgaatgcaatgcacagcacgcgacagacccttgttttttaaatcaatggggatattctacccttttgttaatcattatcgggataggtttagtatacctgctttttaagaaacggaaattcttagtggataacctgaaatggattgcaggtacggtatttattgcaggtttcctgatatattggtatgcttttaatgagggagggagtgacagtaattcgatagcgttggcgtttaggtctgctctgtcttctatggaaatgttcgcttcgcattccgatcttttggaggttcctgaagatctgcatcatgatcctttctacatgacgatattttctgtgatacatttcctggccgttatagtgagtgcggtttttatcatcaaactgttaggattcagatttatctcatgggtgcggttatgtatggcgaatctttcaagaaagaagaaatgccggctgtttattttctggggtgtcaatgataatgcgatattgctggctaacagcataagaaaaaaagcggcagagcccaaggggaagaatgaagaaggatgggagaattgtaagttcattttcgtgaggttgctttctgctaatgaaagcagttctcatggccggttcacattcagtcatttctttaattcgtctcatgacggaactgaaaaatttatagaaaagatagaagagcttgacggcatactggttaactctaaatttggaatcacaggccgggttatagataaagtcaaatcggaatttgatttatacaaatatctcggattgaggagattgggaaacctaatcaagaagtacccgcaggcaactttctatttcttgtctcccaatgaagaactgaatctggaggcggtgtctgtttttaaggaaatagcgaaatgtaaagaagatagagtccataatcaggttcagatttattgccatgcgcgtaagaacaaccagaaccagaagttggaaatatgtgatgggttgaaacatcagattcatatcatcgactcgtctaatcttgctgtattgcaattaaaaaagaatgtgaggaatcaccccgtgaattttgtagatgtcgatacatcgaaggcttgtgtaaagaaaccttttacgtcgatgattattggctttggagaaacaggacgtgatgcatttcgttttctatatgagtttggggcattgatcgatgtaaatggcaataggaaccctcaaaaaatatatgtggttgatgaacatatggatgaattgaaaggtgattttttaatgaaagcacctgccttgaaggagaggaaaaatgagttggaatggtgtgaagaaatgtctatccattccgaacgtttttgggaaaaattttctgaaatcattcatgatctaaactatgttgtaattgctataggaaatgataatgaagggatggcattggcgattgatctctacgaatatgcctatcgatatagaaaggattgtttcaatgattttaggatttatctgcgcgtcaatggaagttgcaacaccattcagctgaagcaaataaaagagtattttaatatttatggcaatacccgggatgtaatcataacttttggagcgcaggaagaaatattctcgtacgatgtggtatcgacagatgtgcttgaagtattggcaaaggaattttattatgcatatcagaaaattatgattgacgcaatgcctgaaacgaatgagaaggaaattgaagagaagaagaaagcgaaggaaagcctgaagcaaacagcggaagaagaatggaatgcgcgtagagaggcattgcaggacaagcatagcttggatgcacaaattaaattggcttatcaggaagagcaggatagggctaatgtatggcatatcgataccaaaaagtttttagccggggccatgggagaggatggcaaagataataaggaaagattgaaagagatggttgagctgacgcagcgtgatgcccatacattgaactattctaaggtttgtgacgttgtttccagtacattatttgataatttgagtaagtgcgaacatttgcgttggaatgcatgtatggaactgcaaggatttgtaacgtgtgacggagataaagactttcagcagaagaagcataaatgcatcgtcgataatgatattttaagaagtaaatatccggaaaccatcccttatgaccagtgtgtggttgagctaagttttagattgaaaaagaactaactatatgacagatcaggaaatagtcgacggattaatcaatcgggatgaaaaaatcaccgattggtttttcaacataaaatatcgtccgttgtttatcaatgtaattaagctgatatttgattaccaggttgattacgatgaatgtatcagcgaactctactatcatctaatgaagaatgatgctgccgttcttcgtaattttgagggacgtagcaccattggaacatggattaagattgtggcaattcgttttttctgttcccggaaaaaacgtgaacagatgatagaagacgagagtaaagagcctctttatgagcagaatcatgaagaagaaatagacgactctgaatcgaaaatagccgcaaagattgatttggaacgtttgttcgatctgatgtcgaataagcggtatgtgatggtcatcagggaattagtactcaaagaggtcgaacctgaatttttagcattatctatgggaataactgttgctaatctgtacaatattaaaaagcgtgcgctggcagcattggctcacttagctatgaatgataagaagaagtatgaaaacaaaagataaaaatatgataaccgaagaattgttggctgcttttgaagaaggtaagacgaatgctgaagaaacagctttggtacttgaatatctggcgactgatgaaagtttgcaagaggaatttatcttgtctcaacagttggatgccatgatgggagctgatgatgaagaaacggacttcctgccaatggcgcagatggcagccaaatcggaaggtaatctttgtgatttccagtgtgagcagtttattttgaaacgtagaaagattgaatataattcggatgaactctcggaggaggccaggaataacagttggttgagggagaggggaactcctttgcatagtgtaggccgcctgctcgaacaacgcggattgattgtgatgcgcagttatggttccagtattgacagtgtcatacgtgccctcaaggccggacatgatgcgattgttgtggtaaatagttgccggttgccggaaaatagcgaggaggaaattgcttatcatgcagcagtagtgcttgacgtaaatgaagaggaagtgacgctttatgatcctgcaacaggagaggaaagtacggcctatcccaaggatcactttattgcggcatggaatgatgcaaaagcgtatcttgcgagagtgaaagtgcctgatctggattataatccgcggcctattgatctggaagatgttgaattgagcactgatttgattgaattgcgtgaagccattgctgaaaatgcgcacgaaatctgggccgaccagcgccaggaagagggatggacttatggaccgcagagggatgacgagaagaaagagactccggacatggtgccttattccatgcttccttattcggaaaaagaatatgatcgacgtatggcgtttgatacgatcaagctgatgaaaaagctggggtatagtattatcaaacagggcgatacggctcttcataatgagctgatgagaaaattgaagaatgaaggtgatgccaaagtctgtgaatgtggtgcgtctatttttatggaccaaatctattgcagtcattgtggtaaaaagatagattggaaattgttccgctaatatataaataatgaatcataaaatgaaagagtatattcccaatccggtggatacaggacatatccaactcccgaaggagttggaatatttggtagaagagatggctaagaatgttcatgaagtctggtcgaaaaccagaatagaacaaggttggacgtatggaaaaaagcgggatgatgtgttgaagcagcatccgtgcctggttccgtatgaagaattacctgaagaagaaaaggtgtacgacagaaattcttcggtggaaaccttgaaactgattatgaaactagggttcaagatttcgaaggatgaggaataggcgatttgcctgcatccaacaagataaatggtgcccaatatttactgtctgcatatccgttctcacgaaggtactgttgcgcttttataagagcctgtcgttcggataaccctgaaatgatgttctcatagaatttagtcatgagaagcatggaggcctggtcgtcaacagctgaaagtgtcatgaggatggtttgtactcctgcattcttaaagcctcgttgaagaccgaaaagaccatccgcaccaagagtaccttgaccggtgttgcaggcagaaagaacaaccatacgacaaccgcggaggtttagtgtactgatttcatctgcacggagcagtccgtcgttattctcttccgtggcattggcgccggacataatcaggaagcaatgcttcatcgcatcatcggcttcacgttgcttcaattctttatagtctccgtgagtagctatgtgaatcaacgaaacagctttgccgtcgagtgcccggaactgcttttccgttccgttttcacctacgaatagattggttttaatcttcttttctttcaatagggaatttacgttatttacttcattgagcgtatatggtaactcatgatacccattctgtccgttacggaatttcccggagttatgatctgtagaaacaatattgcgaactttggttgaagccatttcgtagtctaatcctccgaaaagtgcggctgatgagtagttcagtgaagctttgtcgagtgcgatttcttttgttgacgataaacgatagacggctttctggaatgctaacggcaggttacccgctccatacggaagatattctacaggtaactgatgaagtatcccgtcaggtgaaaaataaatagtatccgctttgctgatatattcatccagcgctttccagaaatgtgccccgttttcggttgtggtgaaagccgtaggcgattgcatctctttcgatagcaatttctgactcattaacttgattgcggtgggagacgtgtcgcccggacgaagtacgaaagcggccaggtgtttgtccggagctagtagttcatcgtctatgagagcaaattctatggcgatggagtttccatgcagatgcttttgtacgtcctgccatttgacagaaagataacgggtatagtcgccgaaatcagtagattttcgcatcaagtccagttgcagctgttcatactcctctttctggcggatgatatttttccgtgcttccgtctgattggttgcattcgggagttcactttgcatggataaaatttgttccgccataagggtagccttgttgtattggtcgagcagggatttatctcccgaagcgcggatcagagactccagttcaatagacgaattgagcataataccttttgaaaacaataatgcatcgtaacctaaccgggcaaaacgttgtttttgttcaggtgtacctgttgcggcgatattggctgcacggaggggaatactgtccagtgaggaacggatatccttccagaatgccaggcgttcatcggctttcgagagacggaaaagattacgcagcgcggttgtttcgctggagaggaaaggttccatataggctaatgccttgtcggtctgtccttgggtatagtagatgtcagcgatagtccctaatgcggagacatacatcaaaccgtcttctccccattgcaggcgataagcgtccaattgttcaagattctctttcaatagcctgtttaaaaccgccattcgttgacgttcggcatcctgttctgtctgcctggctgctgtctcattgcccatcatggtgtggcaacgattcagactgctaagtgcatcctgatattttacatcactgccgggaagaattttgtaaatgtctgcagcctgttggtagtttgctgctgcttctgcatattgtttttgtcggtataagatactgcctctggaacgcagaatttcccccatcttatctgacttatcacccgtcggaagcagtttttcggcttttgtgagtatttcgagggcttttccgtactccttggtgaatccgtagttacggcacaatgcaacggaggcgtctacatatttgtccagtttgtccggcaacatctgtgcataaaccgacagtgcctggttgagcatacgattggaggcctcatacttggcggcaatgctataattgagtccgcccagataagattccaatgcaaatttagcctgttcggcaggattgttgcgaaggatgtctgctgccagttcgtagtattcgccggcagatgcgtgatcttgtattccggaaagaaattgcgcatagttgtggcgtactttaaaaacaatctccttatcagtattcacatcgcatttctttaaagcatccagaaaatgtgcccttgccttatcattgttacctatgctggcaaaatactgggcacgctcggtcaggcaatcaggttcgtcgcaaggcttttccaattcttttttattgtgagcttctaccaatttcatgtattctaatactttcggctgattgttcagttccacgtagatggatgatatccaatcgagaagttgctcgtattcttttgaatcgtcaggaaagatgttgaaggcctgctcataataagtgactcctacatctttacgtcccgacaggtagtacaacgaacctatctgctggagttgacgggcaactgaaagggacttttcgccatacatctttttactgatggctatttcctcttctacgatggcacttgctttgtccatttctcctaaagctatgtagcagcgggcgagattgatatgaaacatgaatgcctgttcaggacggggctgaatgcgactgcacagttcccatgtcttgccatgaatttctgctgctttaggatagtcttttgcaacagtcaggtagtagagtcctgtgttgttcagggaggaaatgtatttgatatttgtttcgcccagtatggtcttgcgcatatctgctgccatttgtgtataggttagtccttcgggacgttccagattcagataacaacggccgagaatgtgcaggcaggtagcgcgttccgcactctgtgtctttcctgttttgacatataattcatccgcttgtttcagtttggtaatggcagttgggtaatcttgtttactttctagtttttgagcttcttcaaccagtaggtcggcttggcttgtagtctgtgagtaggctgtcagacatagacaggctaatagagatagaatgaattgtcgcatataatagagattttagtggattaaaataagatcaaggcaaagctcccgtctctcttgcttttattggtgatcgagacgatgattttatatcgttcatccgagctaaccttttcttttcggaagggaagacctttccggacgctgtcattacatttgtattcccgttcacttttcgattgataaccgattgtctttattttccaactgaaagagcgattcacctctgccacacagcctatctgcgaggttcccgaacagctcggaatctcgaaagtacaggtctgaccggcagccaccattttggtatctaatcttactttgttggcggagtccttatcacctctcatcctcgcttctgccgcatacttgtccgcaatttcatagattgtttcattatcaacgcaggcttgaatgaattcgtagtcaaataccagatgtcctttcaggctcaagacatcgcccttggtttgtttgacggttaatgggataggggctgcatcacgcagcgttttgcttactgccagcagttgttcgccactggcaaagccgccgtccaatgcttcacatgctttcttacaggcgtcgaacaccgtttcaaagggtgtcgttgtctgtgcattggcactcatttgccctccgatggaaaaaaacaggaggatgaatactctgaaaatagttttcctgctcatttttattctgcattcatagtgttattgaataggattaagtaccacacgaaatccgatatgtggttctgatgtatcgtaagtctgtacgctacgatggcgaatgtccatatcacgttcgttggccaggtagctgcctcctctcactatctttttatggtgtccgggattctctgccggaccttggggatctgtgacccgtgtattttcataccggctcatccagtctgtacaccattcggcggcgttgcctgacatgtcgtataaatcgaatccgttttcgcgtttctcgccaacgggatgcaggcgttcattggcattggaggcatagtaggctacatcacgaatgttgtctgaaccggcataaggatagctttcgcctccggcggctgcatactcccattgcgcctccgtagggagggaaaaaggtaaaccggtgagcttgttcagtttcttggtgaaggcctctgcatcattccacgttatatgtgtcataggcagcatgccttcttccgtaacaatggagtcattcataatggcataccacaacgaacgtgttacttcgtatttacacatataataatcggaacttaatacaacggtgtgctgcggtgagtcatatccttttcccatagttttccccatgatgaattctttgtttttggccggaatcagcagcatattattcatcatgtccaccagggagcggagctggggcagtgtgattgtgggattccattttacgtctacccattctttctctctgtcttttatatccctgtttccggtgttgtttacggaagcgcgtccgtcattccggagtgcattgaattcatgcaggatggagtcgcatgtagatttcaaagaactgtccgggtgtttctttatgaaactactataatcgtcataagtgcggcaatccttgaattccagtttttgttctgccgttctttggatggaagtataagttttgcttcctgctactattaatgatagagcaatgaaagtcatcacaagccatttggcagatacataagaaggttttgataacatttgtttcaggaggtcaccctttatatctttgaatcgggctactcgtgagttgctgtaaaatacagcttgaaaatcttttaatccgctaatgtccggtggtagttgcagggtggcgaaatcatagctttcactttcctgcggagcaatcggaatgatatttatctgtttggggtttctactccggcggtgtaacgcacggcctaattctatccggacaaaatcgatttctccggtatggctgatctgcttaatttccgtttcaaactcttcataggtcaaggatgccatccgttcgtagaaagccacttcttccatgtcccatgttgctttttcgcctgtctcgaccgcttcttcattgagcgggcggatcgttgtaaacgtctccggcaccataaacataatgaagtctttgcactcatcaatacggcgaatcaactcaacatcaaaccgaccgtttaaattgtctttatcaaagctcacccttttgcggaatccggattcttccagcatcagttgtagcatttcaggcttgtcgcccgaacatcttttacggtaacttatgaatatgtcgtaattatgcttgctcatcagctgctaagataataaaaagaaacagatttgtcaatcttactcgaaatttatttttatctttgaaattcggtaaacagaaaaaagaaatatatatgaaaaaagtaatttgcagtgagaaagctccgggggctatcggcccttatagtcaggcgatagaagccaatggtatggtatttgtgtccggtcagttgcctattgatgccgctacgggacagatggctgaagggatagaaggacaggctcgccagtcgttggagaatatcaaacacattcttgaagaagcaggattgacaatgggaaacattgccaaaaccactgtctttcttcaggatatgtccctgtttgcagggatgaacggtgtgtatgccacgtattttgacggagcctttccggcacgttcggcggttgccgtaaaagctctgccaaaggatgcgttagtagagattgagtgtatcgcggttcgctaacaaatctgcgacaatgaaactgctgcctcctacaaagatcagatctttgggggggcagttcttttttgccgcctgtacagcttctacaacagtggggtaggtggtacctttcaatccggcttcttctgccaatgccagtagttcattttccggaagcgcgcgtttaacgcttgctttggtaaaataataggtggcatatttcggcaatgctcgcagaaccccccggatgtctttgtcattgaccatgccgaatacaatatggatctcctgatcgaaggttttgtgaatggcattgagctgtacatggatatattcgattccatcaacattatgtcccgtgtcacagataatatccggatagctgtgtactttctgccaacgccccatcagaccggtgagctgacatacgtttgcaagacctgcgcgatagtcctgggatctgatgttgtagttcagacgggtcagtgtcgcaagggcttttaggatggtaaacatattttcgaattggtaagctccgctcaactctgtgaaaagtccgaaaggaaacatctcattgtggattttgatagcatcttttcttttgtcgagtatctggtctagcgtacgtagactgtctgacaggtctaacatgagtaatgcttgccgcatctggtttgcctcttcttctgattgttcgtccattgcttcgatcatttcgtgcatgctctgaattgtgttgtccatcatcggtcttatttcttgcaatttcgaataaggaactatttccatgtcccagtaccgggcattttcacgggcatattcgataggcgcattcttttctttagctttcatggtaaatacacgtttcactgccccttgggctctgccgataacgaccggaactccttctttgataattccggctttctctttggcaatcttcgtcagcgtgtcacccagatattgggtgtggtcgaggcctatgttggtgataacacacaaatccggatggatgatattcgtacagtccaatcttccgcccatgcctacttcgataactgctacatctactttctggtcggcaaaataacggaatgccatagcggtggtcagttcgaagaatgaagggtgcagcggctcgaagaaagagcgatgctcttctacgaaattgactacatactcttccggtatcatctcaccgttgatacggatacgttcgcggaagtcgattaaatgaggggaggtgaatagtcctacccggtaaccggcgcactgcaatacggctgcgatggtatgtgaacaggatccttttccattggttccggcgatatgtatcgtcttgaattgttgatgaggatgcccaaaatgttcgtccaatttgtgtgtggtctctaaacccggcttatatgctttgcctcctatttgttgaaacattggcgcactctcatataagtactttaaagtgttctgatagtccatgttttataatatttaacgtcgggcaatctttattgcccactaatttgtttatctttagaaccgtcaatctgactataaatgggggattggcgaatgagattgcaaatatcaacatttaaatctaagaaatcatgggaactaagaaaaattttgtgctagacacaaatgttattcttcacgactacaattgcttgaagaattttcaggaaaatgatatttacctccctcttgttgtactcgaagaactggataagttcaaaaaaggaaacgagcagataaatttcaatgctcgtgagttcgtgcgcgaattggatgtgctgacaagcgacgagcttttctccgacggagtgaagcttggcgaaggattgggacgtctgtttgtcgtgacaagcaatgtgccggctgccaaagtgtgggaatcgtttcctataaagaaacccgatcatttgattttggcggcaaccgaatacctgaccgacaagtatccgaaaatgaaatctatcttagtgaccaaagatgtgaatctgcgcatgaaagcccgttcaatcggtctgctttgcgaagattatattacggataaggtggtaaatgtagatgtgttcgagaaatctaatgagatttttgaaaatgtagatccggcattgatcgaccgtatttattcttcaaaggaaggcattgacttgagtgaatttgactttaaggatttgattcatcccaatgaatgttttgtattgaagagtgaccggaatagtgtattggcacgctacaatccttttacccattctattatccgtgtgatgaagggtaagaattatggaatcgaaccacggaatgcggaacagagttttgcttttgagattctgaatgacccgaacatcaaactggtggctctgacaggaaaagcgggaacaggtaagactttgctggctttggctgctgctttgggcaagctgacggattacaaacagattttgctggcacgtcccgttgtggcgctttccaataaggatatcggtttccttccgggagacgcacaggaaaaagtagctccttatatgcagccgttgtttgataacctgaacgtcataaaacgtcagtttgctacaaactctaccgaagtgaagcgcatagaagatatgcagaaaagcgagcagctggtgattgaagctctggcatttatccgtggtcgtagtttgagcgaaatgtattgcatcattgacgaagcgcagaatctgaccccgaatgaaataaagacaatcatcacccgtgcaggagaaggtacgaagatggtatttacgggagatatccagcagattgaccaaccttatctggatagtcagtccaatggcttggtatatatgattgatcgtatgaaagaccagaatatctttgcacacgtcaatttgctgaaaggtgaacgaagtgaattgagtgaactggcaagcaacctgttataacagatttctctgctaagcgagataaattaataagtgattaaaaaagtaaacggtgaacatcctgttgcaaatagcacaatttgttcaccgttttctttattgatttagtatactttttccttattctttctttccgaaatatttcaggaactgtgtacgttcgaatgtattaacaccctgaacatccttaatattcagtttgcctttgaattgagctatattcctgaaccctttgcgttccatccatgcagagaggaagcggttggcttctccgatgaatgcatttgtatttagatagactgcgctacaaacttctacagccgaagcaccggcaaggatagctttcactactgattctgcattggcaacaccaccggaagctgcatagtcgatcttgtctactactgcagacgcaattccgatccaacgaagcggaatggcgaggtcggaagcattgctgaatatttcgcctgaaatatgctccatcttttcgatattgatgtccggctgatagaaacggttgaagagaacaactgctgctgcaccgttggcatacaactgatcgattaatgccacaggatttgtcaggttatcacccagtttcatgattacaggtatcttgattgtttttttaatgtggcggagaatatcgatgtggcgttgttcgaatgaaccgtatgtatattgcacttccgattgcagggcaaggatattgatttccaatgcgtcggcaccggcttcttcaatcatctttgcaaagtcaatccattcggaatcagtgtagcagttgatgctggcaatgataggaatggggcataccttcttactttcttttattaaagtcaggtattcggatagcttgtgctcacggatatattcttccagatagtcactggcttccggatagaaagccggatctttcagttggtctgcttccagcatgatctgttcctcaaacagtgatttcagaacaattgcaccggcaccatcttcggccaattttttgtttttgccggcactgttggtcagccccgagctactgataatgatagggtttctaagggaaagccctgcgaaagtagtttttaaatcggtcatagcaatatgttttttactcctgattaataaattcgttctccgaaaatcttgcttcctacccgtaccaacgtacttcctgcggcaatggcttcgtggtagtcatgtgacattcccatcgacagctcgcagaaagtatcggagtggatgaaccaagttgtttttatctcgttaaagagcctatttagtaaaccaaattcccggttgatttgttcaatgcaatcggtgttgctggccatccccattaatccgcagatgcgtacatgagtcagctctttccattctccggcattcaacatctccttacattcttcgggactgaaaccaaatttggtttcttcctgcgcaacgtgaatctgcaataggcagttcactgtacgtcccgctttgacagcttgtttgttgacttcggccagcagtttataactatcaattccatgaatcatcgctacgtatggtatcatgtatttgattttgttcgtctgcaggtgtccgatgaaatgccattcaatgtctttgggcaaactttcgtatttagctgtcatttcctgcactttgctttctccaaaaatacgctgtcccgcctgatatgcttcttctatcgcttcattgggatggaattttgagacagcaaccagccggactccttgagggagttcggccagcacttgctttaaattgtcagcaatactcattgttacttatgcttttgatggatcaaactccggtttgtcattcggttcggcgctgtaaggatatacatccatgagcggagtctcggataccataccgatctgataatctgccatggttcctttcattccttcatccagcttcttgactgcgtcgcgcaagtcggcagcttgtaccagtacttgggtggaagtctttttttcagcaccgcttttttcatccagagtgatgaaaataagtttgcatttgaaccagcggtcggcactttcttcgtcgctagggaaaagttcgctatagttggcacgtttaatatccgaaacggtaaattctccggagataaacggagtcatttcttcaataatccgtgcttctgcttctgtaaaactgagtgcgtcaacaagataaggttcagttactttcttctgcattccgttttccattactttttcataacggatcttgcactcaaaccatgtatgcattgccataattttcttcctttttaattaattgatttatgtaaattgcctacaaagataaacaaaatcccaaagtaagtgccgaaagctttttattttcttttatgcagattctttaattcaaatgaaagcatgacacggaaaagtccgatgatgaggaaagcaaaagaaatcatatacactgcgtagagcgctcctatggcgggttgccataatattaaaagagagcacaggatggcaagaataccgaaagccatgtaccagccccagtcgcgggttccgtaacgtttcaggtcgatggaatagccggtggaggagaaccctcggaacataagccagaaggctatgatgaaagggataacttccatgctgaccatcggataggcaatcaggtaaatacccagaacgaggtcgatgagtcctcctacgatataccacccccagctcgggacacctttccggttgctaagagcgaagatgatttccagaataccgcttatcagcatcgatacactgaaaatgatacttagagctacataggtgcttacgggtgagaacatgagccaaagggctacaatgatatacacgattcccaaaagaagagaagtccaccaattttttactgaatgttgaatctcattgaatacagtttccatacattttatattttaaattgaacactagagtgatttcgttgaggaataacaaattgaatttagaaaaggttttccgtgaacatatttgggggaatagttgtttcctatataaagtaaattttaaatatacatgcattatggcaacaacaaatttcaaaggacaaccggtgaaactgatcggtgaatttatacaagtaggtaaggtagctcctgacttcgagctggtaaaaacagatttatcttctttctctctgaaagatttaaatggtaaaaatgtgattttaaatattttccctagtctggataccagcgtatgtgcaacttctgtacgtaagtttaataaaatggctgccggattgaaagatacggtagtattggctatttctaaggatcttccttttgcacacggccgtttctgtacgacagaaggtattgaaaatgtaattccattgtctgatttccgcttctctgatttcgacgaaagttacggagtgcgtatggcagatggtccgttagcaggacttttggcgcgtgcggtagttgtgattggcaaagatggcaaaattgcatatacggaacttgttcctgaaatcacccaggagcctgattatgacaaagccttagctgctgtaaagtaatatagaatatggagtattaagtattaggtattaactattagttgcagctaataaacgaatatggctaatacttaatacttaagcctgctacttatcttaaagattttgacctaatgggaactggtaaaaaggcttggtaaactgccaaggctccgttcttgttaggttgtgttttttctacactaaacctcaactatcatgaacaaaatgaaaactctattcatcgccctgttatgtatgggcgttggaaccttgtcggcccaaactgccgatagtacacaaatttctccctggacaaaagaaggatttgccggactgaaactaacgcaagtgagcctcactaattgggctgccggaggtgataactccgttgcctttgacttgcagggcacttatcagattaattataagaaaggaaaacatctgtggaataatcgtatcgaactggcttatggattaaataagaccggtgacgacggaaccaggaaagcaaatgataaaatctatttgaatacgaattatggctatgctattgccaaaagttggtatgccagtgcgttcgccactttccagacacagttttctccaggatatgactactccgtcaataaagacattgctatctccgaatttatggctcctgcctatttgactaccggtttgggctttacgtatgatccgggtaagatatttaccgttgtattgtctcctgctgcgtggcgcggaacatttgtactcaatgaccgtctctctgacgaaggagcttatggagtggatccgggcaaacatctattatccagcttcggtgctaacttgaaaggagaagccaaatatgaattcttgaaaaatatgacggtatattcacgtttggatctatattccgattatctgcataagccgctgaatatagatgtgaactgggaagtacaagtaaatatgattatcaataaatggttctcaaccacacttactactaacctgatgtatgacgatgatgtgaaaatcgtgcaaaaggatggtacaaaaggtgctcgtgtgcaatttaaagagatattgggagtaggagttcagtttaatttctaattagctcttatctaccacaaaaaataaaccacagaggacgtagaatacacaaagaagtaagaatttaacgggtaatagccgatttacaataatggatgccccggtaactctatgttcttgctttgtgttctctgcgtcctctgtggctttgcaatgagtattttactacttattttctttttttcagccctttataagccaaaaaaacgattacaattaccaccactgctataatggcatagccgatttcgtgactgtattcggtggccattacatagacatcgttagtcgttttgaggtctgtaaaacggtaaatcaggtatccgagcaaagctaatatgctgttccatatagcagcgccgagagttgtataaagcaggaaaggacctattttcatgccggctaaccctgcgggaatactgataagttggcgtacagccggaataagacggccaaagaaagtagaggctgcaccgtgctttctgaaatattcttctgcatggtgtattttctcttcgtcaataaggcacatgtgccctaaacggctgttagcgaatttatagataataggacgacccaaccaacgtgccaggtaataattaactaatgcaccgatatctgctcctatagttgcaaataggacaacgagaaagatattcatactgtcgtctgccatagctttccatgcggcagggggtactacggcttccgaggggaagggaataaaagagctttcgatagccataaaaatagtgactacccaatagttcaagttttctaatacccatttaagaagttctgctactgattccatgttttttgaggatagaatttataaattgatttatttttttccttttgtttttttcttattctcttttttcatgcgttcccacacttctttgagagttctttcgtcttcttctctgtgttcgggactgttcaacagatccaggatcatgtcttcttccagtggatgttcacattccttgttatatttaaagaagttgtcgatttcaccgtgcatgaggcaaagaacactcaatttctccgtcacatcttcgtatttcggatttatctggtacactttttcaaagtattctttcgcttcgatcagatagtcactttccgaataagcagaggcaatcatataccacatttctatgttcggattgatctctatcgctttttcgaaagagatggcagcttcgtcttccagttcctctgccaggtatagttttccttctgtcagataaatcaatccctcgttcgggtttatctctttggctttctcgcataactcatgcgcctcttcatacctttccaggtgagagagggcgaatgctttgctggtataggtgtctatcaataaaatagactgcttgtctccgtcttcttcaaaacgttcgatcactttgtcgtaatagtcatcggctttttgccattcttctttattaccgtaggatattcccataaacatgtaacccagttcggggggaatggctttgagctcaatcgccttttggtaattctcgatggcatcatccgaattgttcagatagaagaaacaatgtgccttgtaggcataagcttccccgtactgatcgtcggctgccaatgcgaaatcacaggcttcgatggctttgtctatttgttcctggacaaagtaacatttcaccagtcccatccagtaggaagggttgaatggagatttgtcaatgagtttattgtaatagatgatggctgattctacctgatgggtcgatgccagataatcggctgtgagagccatgtattcttcatcttcggtataacgggatttacctctgtcgagccattctttggctgcgtccgggtatcccatgtccagatagagaaatacaacatcaatgattgtttccagctcgtcggcatccgctattgtgcttaacagccattgagcttcctccagttttcctccattcagcaatagttcggctttcagcagtttcacttcggaatcaaattcttcggtaatcgaatccgctactttttttgctttttgcagcttttgggtatccaggtaaagatatgcttgttctataagcaaatctgtgtttctcggatgtattttaagtccataagtgattacttcttgtgcttcttcaaattttcgctcggaggcataccagtcggcgatgccggccaattggtcagcatccagataaagttgtcggttttctgcttttgcttcttcgtagtttgtgattagtgtgactagttccttttttgctgatggcgaattttttctacccattttacttttagatttttaattgctaagatggggctgttgcaaaagttcagatgatgatccttttgacacagccccattgtaaagttaagcttgaaagcttagttatttattaatcttaccccatgtgtctttcaaccctactgtacggttgaagattagtttatccggggttgattctttgtcaatattaaagtaaccgatccgttggaactgcagataggagagtggaggcagggtagctgcgaacttctctatgtagcagttgggcagaactttcaatgaatccggattaatgatttctttcatggcttccagtgcttcgcatttttttgcttcgcggatggcggccagttcgtcacgtggattttccactttccacaaacggtcgtacaaacgtacttctgcttgcaggcagtggttgcagcttacccagtggagcgtacctttcaccttgcggttcgcatccggcatgccgctgcgggtatttgcgtcatattcgcaatatacttctgtgataacaccgttttcgtctttcttgcaaccggtacatttcacgatataagcatttttgagacgtacttcttgccccggtgtcatgcggaaatatttcttgggagcgtcttccatgaagtcttcgcgctccatccacaattcgcggctgaactcgatcaggtgacttcctgcttccggatcttccggattgttgattgcttccagttcttcaacctgtccttccggatagttggtgataatcaatttaaccgggttgattactgcagatatacgggtagcacggctgttcaaatcatcccggacagagctttccaacagggcgatgtcgttcagggcatcgtaagtggtatatccgattttatcgataaacttatgaatggacttcggtgaataaccgcgacggcggaaaccgcagatcgtcggcatacgagggtcgtcccatccgtttaccaatccttctttcaccagtgtgagcaggttacgtttgctcatcagggtgtaacttaggttcagtttgttgaattcagtctgacggggacggttgtcgttcaggtcttttccttctttcaaccaatcgatgaagaggtcgtaaagcggacggtgtaccacaaattcaagtgtgcacagagaatgagtcactccttcgaagaagtcactctgtccgtgggcgaagtcatacatcggataagctttccaggtagtacccgtacggtggtgcgggtgtttcactacacggtaaataatcggatcgcggaagtgcatattcggattagccatgtcaatcttggcacggagcaccatggcgccttcttcgatctcgccgctattcattttcttaaaaagttcgaggctctcttcgataggacggttccggtaagggctttccacacccggttgggtaggagtacctttctgctgtgcaatcagttccgaactctgttcgtcgatatatgcttttccctcctgaatcaggcggatagcgaagtcccataattgttggaagtagtcggaagcgtagtattcgtttccccactggtagcctagccattggatatcttctttgatagcttctacatattccacatcttccttggtagggttagtgtcgtcgaaacgaaggttacatacaccgccgtgtttttctgcgatgccgaaatcaaggcaaatagctttggcatggccgatgtgaagatagccgttgggctcgggcgggaaacgcgtctgcacttttccaccatttttaccttctttcaagtctttctctactgcctgttcaataaagttcaagcttttcttttcgcctgcttcttcgtttttaatatctgtcataacggttaatgttatctgtatttaggctacaaaagtaggacattttttttatttaaccggaatataaccgctcttttttataatgtcctgtccgtcggatgaaagaataaactgaatcagggggctaacttgttccttattttttacattgtaatagtagtaaagcggccggacgatagggtaggttttgttggtggcattctctaccgtaggggtggcgtagtggcttccgtcataagacacggaaagcgttttgacacggggagacacgtaggccagtcctacatatccgatggctcctttggtctggctgacagactggataatagcacctgttgccggcatggaaaggctgcttgccatgtagtttttatttttcagtacgctctctttgaaaaattcgtaagtaccggacgatgtttcacgcgagtagactactatttttcggttgtctccgcctacctgtttccagttggttatcttcccccggaaaatatcctccagttgttggcgggtcagctgtttcaccggattagagggatgcaccaccacggcgagggcgtcgtaggcaacaatcacttcgtttacttcttctcctgccgctttaattttcatcttctcgctgaacttgattgggcgggaagccattgcaatgtccgttgtattatccattaaagcggagatacccacaccggttccgccaccggttacagtgacacgggcattcggatgctggttcataaaccgctctgctgtctgttgtgcgacaggcagtaccgtgtcgctaccttttatacgttgtgcgttggcaccgagcgagagtaaggaaagggcgattaataagtttcttctcactttcatatttcttctttttattgactttgcaaattaagcaatcgaatattacatttccatttcatccggaatggaaatgatacttgtaacacaaacgtaacatgattgaaacatttccttcaaacgttagtcacacctccttaataaagagacgctttctttgcatcagaaatcatagtaggtatgaaaaaggtatttgaaaggattatagaaggaatgttgacttgtagcggtttcgtgacaagtattactattctgctgattgtactcttccttttcacggaagctttcgggctgttcaagagtaaggtgattgaagagggatatgtgttggcgctgaataagagcaacaaagttagtgtgttgagccctgcacagataaaaaatgtttttgatgaggagatcacaaactggaaggaactcggtggggaagatctccctatccgggtttttcgtttggaggatataacgcagtattatacggaggaggagctggggcctgcttatgaatatgcaggcgacaagattacggaactggtagagaaaacactgggtatcgtagcttttgttccgcagaagtttattgttcatccggacgcggtgcatttcatagaggataacaccatttccgtgaaagatgtatttgcgggtgccgaatggtttcctacggccactccggcagctcaattcggcttcctgccgttgattaccggtacgttgtgggtgagtctgttcgccattctttttgctttgccgttcgggctttcggtttctatctatatgtctgaagtggcaaacccgaaagtgcggaactggctgaaaccgattatcgaactgttgagcggtattccttccgtggtctatggctttttcgggttgattgtcatcgttccgttgattcagaagttgtttaatcttccggtgggagagagcggcctggcagggagtatcgtactggccattatggcattgcccaccatcataacggtgacggaagatgcgatgcgtaactgtccgcgtgcaatgcgggaagcgagtctggcgttgggggcttctcaatggcagactatatataaggtagtaattccttattctatttcgggtattacatccggcgtggtacttggcatcggacgtgctatcggagagacgatggcggtattgatggtgaccggtaatgcggctgtgattccgacaactattcttgagcctttacgtaccattccggctacgattgccgccgaactgggagaggctcctgcaggtggtccgcactatcaggcattgttcctgttgggtgtcgtactgttcttcattacattgattatcaactttagtgtggaatatatttcttctaaaggattaaaacgtagtaaataagatggaaatacggagtaataataaagctaaacaccgttcgcagaaatttgctttcgggattttccggttgttgagtctttgcattgtattgatattgtttgcgattctgggatttatcatctataagggaatcggtgctatcagttgggattttatcacttcggctcctacggacggaatgacaggtggcggtatctggccggctattgtcggtaccttctacctgatggtgggaagtgcgctgtttgcatttccgataggggtgatgagtgggatttatatgaatgagtatgcgccgaaaggcaggttggtacgctttatccgggtgatgaccaataacttgagcggtattccttccatcgtattcggattgttcggtatggcgctgtttgtcaattatatggggtttggtgatagtattctggcaggctctttgacattaggtttgctttgcgtacctttggtcatccggacaacggaggaagccttgaaagccattcccgacagtatgcgtgaaggtagccgggcattgggagcgacgaagttgcagacgatatggcacgttattctgccgatgggtatgccgaacattatcactgggttgattctcgccttgggacgtgtttcgggagagacggcgccgattctgtttacttgtgccgcatacttcctgccgcaacttcctaccggtattttggatcagtgtatggccttgccttaccatttgtatgtgatttccaccagtggaacggatatggaggcacaactgccgctggcttatggcacggcattggtattgattatgattatcctgttggtgaatctgctggctaatgccttgagaaagtattttgagaaaagagtaaaaacgaactaaattagtatatggatacagtgaaaatagatgcgcgtgatgtgaacttctggtatggggactttcatgcattgaagggcatcagcatgcagattgaggaaaaatcggttgttgcttttatcggaccgtccggttgtggcaaatctacttttctccggcttttcaatcggatgaatgatttgattcctgctacccgtctggagggagaaatccgtatcgacggacataatatctatgcgaaaggcgtggaagtggacgaactccgcaagaatgtgggaatggtgttccagcgtcccaatcctttcccgaaaagcatattcgagaatgtggcttacggacttcgtgtgaacggaataaaagataatgctttcattcgccagcgtgtggaggaaacattgaaaggagcggctctttgggatgaggtgaaagataagttgaaggaatcggcttatgcactgtccggcggacagcagcagcgtctttgtatcgcccgtgcgatggctgtctctccttcggtattgctgatggatgaacctgcgtctgcgctcgatcctatttctacggcgaaagtggaggagttgattcatgaactgaagaaggattatacgattgtaatcgttacgcataatatgcagcaggcggcccgtgtcagtgataagacggcgtttttctatatgggagaaatggtggagttcgatcagacgaaaaagatattcaccaatccggagaaagaggctacccagaattacataacgggacgttttgggtaatccgggtatctggaacccaattgatagaatattaatcatttatatataatagactatggtaaagtttatagaatcggaactcatcctattgaagaaggaaattgatgaaatgtggaccttggtgtacaaccagcttgaccgtgccggagaggctgtgttgacccttgacaaggagctggctcaacaggtgatggttcgcgaacgcagggtgaatgcttttgaattgaagatagatagtgatgtggaagatattatcgcattgtataatccggtggcgattgatcttcgttttgtgttggctatgttgaaaatcaatacgaacttggaacgtttgggtgactttgcggaagggatcgcccgttttgtacttcgttgcaaagaaccggtattggatgcagagctgttgtctcgtctccgcctggcagagatgcaggcagaggtgttgtcgatgctggaactggcaaaacgtgccttgaatgaagagagtaatgatttggcggcaggagtgtttgctaaggataatttgctggatgaaatcaatgcggatgcgacaggaattctttcagactatattatcgaacatccggaagctgtacatacttgcgtagatttggtcagcgtgttccgtaaactggaacgttcgggagatcatattaccaacattgccgaggagattgtattcttcattgatgccaaagtgttaaaacatcgtggaaaaaccgatgaaaattacccggaaaagtaattttctgccgatttttaaacagaaattagggctccttaaaaaattatcttatatttgtctcctgtaacggacaagttacaggagattttgcttcaaatgataataaatccaaagaattttcaaaaagatgttatatgacatgttttataatttggatagtatcggtaaaaccgcctatatttgcaccgttatcctgaaaacaatctttttaccttaaaaaaaaactaatacctattgaaaactgaaaaatggagctttgtgaaaagccccatttttttttgctcttattttctaagctgcttccttattcgtatctttgacccttgcattaagagagtactttcaattgtaaaatcgtaaatagtaaatagaattatgttttctggaatcgtagaagaatatgctactttggtagcactggtgaaagaccaggagaatatacactttacatttaagtgttcgtttgtgaatgagttgaaaatcgaccagagtatttctcacaatggtgtatgcctgacggtagtgactctgacggatgatacgtatacggtgactgccatgaaagaaacgttggagcgttctaacctcggtttgttgaaagtgggggataaggtgaacgttgaacgtagcatgatgatgaacggtcggttggacggacatatcgttcagggacatgtggatcagactgctacttgtatcgatattaaggatgcggaaggcagctggtattttacattccgatatgcgtttgacaaggagatggcgaaacgcggatatatcaccgtggataaaggttcggtgactgtgaacggtgttagcctgacggtatgtaatccgacggatgatactttccaggtggctatcattccttatacatacgagcatacgaacttccatacgtttgagattggcagtgtggtaaatatcgaattcgatattattggcaagtatatcagccggatgattcaatataaataagaaaatataaataagtgactggaggattggaaatggcatatactgattttcttcaattggtgcaggctcgtcaaagtgaccgttcgtatgataaagaacgtccggtggagccggaaaagttggaacgggtacttgaagctgcacgtttggcgccttcagcctgcaacgcacaaccttggaggtttgtggtcatcacagataaggaactggctcaaaaagccgggaaagctgctgctggcttgggaatgaataagtttgccaaagatgctcccgtgcatattctggttgtagaagaatctgctaatataacctccctgcttggcggaaaggtaaaaggcaagcattttccgttgatcgacattggaatagcggctgctcatatttctctggcagctgaagccgaaggtttgggttcttgtattctgggttggttcgatgaaaaagagctgaaacagcttgccggtattcctgcttcgaaacgtttattgctggatattgtcattggctatccggcaaaggaaaaacgtaagaagataaggaagccgaaagaaaaggtgatttcatacaatcgttattgattgaaaaataattatattcttaaccctttaggataagcatataacagaaagcatcgttggttttaaaggaaggggacgttcctttaaaaccaacgatgctttccttttaaaggaacgacctgtttctttaaaaccaataaatggcttttttaagtgttgatagttagcgtgttattgatgccgcttttccggcggcatcaataatgctatatttatttcttttttgacaaatctttcaataggtagtctactgctgctttcagttgtgcatcttctcctttcaggctggctgccggttcgttataaactagaatatcaggttgcaaggtctgattttcgagatagttgccttgcatatccatgcaacccacctgcgggataccgaatacaatagacggatctatctggcgttcccaccacacggcggtcattgtgcctgccaccggggcgcctaccagtttaccaatacctagagtcttatatacgtaaggagtgccatgagcattgctgtaattgtcttcacaagttagcatgcatgaggctttcagccatttgttgaatggatcgctgccgatatattgtccgcgtggcacgaaacgttgatattcctttccactaagtaaggtgactacatcatcgtgcagccatccgccaccattatggcgggtatctaccactacggcttctttattacgataacggccgagtagttcggaatagatcttgcggaagctggggctgtccatacctttaatatgtacataagcaatgcgtccgccggaaagctcttccactttcttggcgcagcgctctacccaacgtttgtaaagcaggtcgctttgggttccatagctgattgcttttactgtttcttcaaaacgttttttagtagaaggatcgtatacggtaagtactactttgcgtccgactttgccttcaaataacgggaagtaatcagcaccggcttcaatcgctgtgccgtctactttttcaatgatgcaacctgccttcacttctgtctttttctgggtgaaaggactttgcttcatgatttccttgatctttaacccggcaccgtcgtatgactcatcgtaaaagactcccagagtagcggtaggcattgcgctgcctcctgctgcaaaccgggctccggtatgggaaccattcaattcgccaagcaattcactcaacatttccgtgaagtcataattgttgctgatgtggggcaagaagcgttcgtatgcttttttatatcctttccagtccactccatgcaagtcggcaatatagaatttgtcatttacttgctggcaaacgtggtcgaagatgtatgcgcgttcatcataaggacggtaatcgaagaatgcttcaaattctatcggtgtaattttgctaccggcaatctctatttttttcaatcggccacctgtgcacataaagatattctttccttctttatccggtatgagtgagccgccgccaactcctttcaataatattttagtcgtattttctttcagtttatgctcccaaaggtcatagtctccttcaaaagctgccaggtaataaagaatatcacccttcggactcatgacagcgtcacccaggcgggaagaatttacagttagacggacgatgcggtcaaaacgattctccaaatcgaatgtaagagggttcacttccgtactgtcttttttcgcattctcattctggttcgttttcttcttactgtctttagtgtcttctttcttctctgccttttctttcttggctttttctttttctgctttctctgccttttccgcttcttcaagtaaggcaatatcttctttgctcatcaggaagcggttgtaggcatcgacgtcgaaaaacataatataggtgtcgtcttcacttccccagctaccatggctacggtatccggcacggtcactgttccatatcattgcttttccacccaacacccatttggcgttgctgtcgctgtatccgctttcggtaagattgaccatttcgccttttccgtcggctttcagcaaaacgacgtctttattattccagcctcctatgccaatgaagtctgatagaatccattggctgtcggggctccattggaaccattggtcaccgtcggcataagaatattgatatttggcatccatcactgtgcgcacagccttgctttttagattgatgacacggatagcggtacggttctcgaggaaagcaacctctttaccgtcaggactgaattgtggttggaaagaagcgactttggagtttgtcaaacgttcttctttcaattctgtggcataggtgaattgtttctcctctttgcgtacgatggtggaagtgtaaagctgccacaatccatcgcgttctgaagaatagacgagtgtgcgtccgtcgggagcgaaactgatgttacgttcctgatcgggtgtgttggtgatttgtttggttgttttgtagtcaatggaggttacgtaaacatcaccgcgcataatgaatgcaacctcttttcctttgggagatacagcgatgtcggtagccccgttggatttgatttggcggataatatctttgtcattcttgtctgccaggatacttatatttaccttttggggttgtttgcccggagtaagtgtataaatctcgccgtcataaccataacagagtgtgccggtggttgaaatgcttagaaaacgtacgggatgctttgtatggaaagtgatttgttgggaagtggtggttccgggagtacgttggaatatattgaaggaacctttctcttcacttagataatagaatgatttaccatcaggactccataccggttcgcggtcttcacctccgaaagtagtttgtttttgataaacaggttttttcccgggagtgtatgtccagatgtcacgggcaataggggatacctgatgcttgcgccaatagtcttcgtatcctttcttgtcctgatagagcatcactccctctttattaatagagatgcactccattggcatggatgagaacatagcggggcgtcctcccgtcacggctacctcgtacacttgctggaactggccggaaggaaacccggcatcttcggcagagggagcaatgttggctgtgaataaaatgtgtttgttgtctttgtaggcaacaggtttctcactgcctgaatgagtggtcagtcgctggggggctcctccttcactggatacgacgaaaacgtcgagacttcccatgcgatccgatgcaaaggcaatttgtttactgtcgggactccataccggttccgtatcaaaagccggattggtggtgatttgtgtggcacgtccgccggttgacggtaccgtgtagatgtctcctttgtaggtaaatgcaatggtggttccgtctggagaaagagcgcagtggcgcatccataaaggagattcttgtgcaatgcttgtccctgctagacagatgacaaatgcacttagcagtagctttttcattttttctaatattgtgttaagttcattttcgcgatttaaggtttgactttcctacaaatccttcagtaatactttacttgcttttttatagtattcttctctggattcggtcagcaccttccattcgtcgttgaattcttcgtctttgtctattttgaaattctcggagccgtatgtgtccaaacggtccagcaggacagccacattcagttgattgatatccattgaaggctggtaaccgatttcttcgcttttttcgtcggtaacaacctcgtgaatcaattctatttcctgtaactgataaagtacctgatttgtcagtcggatggggatctgatgctcctccgatatttctgcagccgtatagggcggttcgttcttttcgaatcgtttggctataagtgacataatcaggatggatataaaatcccggtatcgtctgctgatgttccgggtgtcctggtcaaagctaaagctgcggatattctgtccggcatacgtcagttcggctccaaacaaacagattgtccaggatatctgcaaccaaagcagaaataagggaagtgcggcaaaactaccataaatggcattgtactttgacacccacaactggctgttgatgtacaggaactgaaaagcctgataagcagaccctgccagaatacctgcaatgagagcgtgtttgaatttcactttcgtgttcggcatgaagatgtacagcccggtgaacatcagccatgtcaggacaaaaggaataagccgtatcatgaatttcataacaggagcgagcaggacgaaatcatccatctgcttgagaatggtgctcataaacagagaaagtcctccggataccacgatcagaatcggcatcagcaggaacatggagaaatagtccgtaatcttgcgatacatggatcgtgcttttttcacttcccaaatacggttgaaggtgatttcaatattactgaccagattgataaccgtccataacaacattaccaaaccaactccaatgaaaatacctcctttggtctgtgaaagataggaattgacaaatgagagaatggcctccgttgtttctgtatttcctccaaaaccgttgcggaactgatgttccatcaggttgtcgaacccgaaaccacgcgctacggcaaacaggatggcaagtatcggtacaatggcaagcaatgtgctataagtaagtgcagaagctttattggccatccggtctttggtaaaccgattgatacaaagatagacggtctttataatattgtagagtgagaacttggtccgggtcacttcgtcttccgtaatgcgccagatgtcatacgtaagaaacttccatatatcggtgattttcttcttcatagttcttcgctaattactaattgcaagcaactaattactgattacaacagacttgcttgaacagtcgatcctcatccattagtcatttgtaattaaatggataattaaaagaaaaagcagtcagcctataagccgagttctgtacccatataatttccgattattaatctttaattatatcaggtgcctgtcatttatctgagtggcgtgtcaccacgacactttagcggtctaccctccgacatggagcgagcaactctcataacgccggtttacatgaccttacaactcctaagacgtacagcccgcatgtcgccatgcgactggtgggctcttaccccaccttctcacccttacctctccccgaaaggagcggcggttattttcttctacgttactctaccctcgcggacagctttctgttaggaagtaggatgctctatgttgcccggactttcctcctgcacgaaacatgcacgcgacagaccggccaactgctttagactgcaaaaatacgtcatttattttgttttagccaaagaaagtatcacaaatagaaataatttctaactttgctatcattaaaatagattttaatgaagaagaatatcctccttttctattgtttcctggcgacgatggcagctagcctgaaagcacaggaaatacgtcccatgcctgccgattcggcttatggggtagtacatatttcagtttgcaatttgcgcgaggaaggcaaatttacttccggcatgagtacgcaggcattgttgggaatgccggtcaaggtgcttcagtataacggttggtacgagatacaaacaccggatgattatatcggatgggtgcaccggatggtaattacccccatgtcgaaagaacggtatgatgaatggaatcgggcagaaaagatagtggttacctcgcactacggatttgcgtatgagaaaccggatgagagttcccaacccgtatccgatgttgttgcgggcaatcgtttgaagtgggaggggagcaaaggacatttctatcaagtgtcttatcccgacggacggaaagcatatctttcgaaatccatttcccaaccggaagcggaatggcgagcttcactgaaacaagatgttgaaagtatcattgaaacagcttactcgatgatgggaattccttatctatgggcaggaacctcttccaagggagtggattgtagcggactggtacggaccgtactttttatgcatgacattattatcccgagagatgcctctcaacaggcctatgtgggcgaacatatcgatattgctcctgacttctctaatgtcaaacggggagatctggtgtttttcggccggaaagcgactgcggaacgtaaagaaggtatttctcacgtcggcatttacctcggaaacaagcagtttatccacgcattgggagatgtgcacgtcagcagcatgaatcctgcggatcaaaactatgatgaattcaacacgaagcgtttactttttgctgtccgtttcttaccttatataaataaggagaaaggaatgaataccacaaataagaaccccttttatcaataaaagaatgcagaacaggagagattttttgaaaacggcagctttggctgctttcagttcggggttagtagcccgtcaggcactagccggagaatcgttgctttctaccattcatataaataagctcggtttgggagggaagatgaaaatgacttttttcccttatgaattgaagttgaggcacgtgtttacagttgccacttattcgcgtataacaactcccgatgtgcaggtagaaatagaatatgaaggcgtgacgggatatggagaagcctctatgcctccttatttgggagaaacagtagagtctgtgatgaatttccttgggaaagtgaatctggaacagtttagtgatccttttcagctagatgatattttgtcatacgttgacagcctctcgccaaaggatacggcagcgaaagctgcggtagatatcgcccttcatgatctggtagggaaactattaggcgctccctggtataagatatggggattgaacaaagaaaagacaccttccactacctttacgataggcatcgatgcgccggatgtagtgcgggcgaaaacaaaagagtgtgccgatcagtttaatatattaaaggtgaaactgggacgggacaatgataaggagatgattgaaaccattcgttcggtaacagaccttccgatagcgatagatgccaatcaaggatgggcagaccgccaatacgcgctcgatatgattcattggctgaaagaaaaaggcgttgtgatgatagaacagcccatgcctaaggagaggctagaggatattgcctggataacgcaacagagcccgctaccgatatttgcggatgaatccttgcagcgtctgggagatgtagccgctttaaaaggcgctttcacgggaatcaatataaagctgatgaagtgtaccggtatgcgtgaagcatggaagatggtgacattggctcatgcactcggcatgcgtgtcatggtgggctgtatgacagagacttcctgtgctatttctgcagcttcacagttctcgccattagtggattttgccgacctggatggcaacctgcttatctctaatgatcgctttaaaggggtggaagtggtgaaaggaaagatcactctgaatgacttacctggaatcggtgtcatgaaaatctgactttactgaatgaatgtcagagtgttaaagccatctgacatacaacgaatgtaaatttgtcaggtgttgtcgttaaccgctgttaagctctaaatattctctgttaaaagtggacaaaaaagagtgacaagtagaataagtgaacgatatttgttattattttaacgtcgtaaaagttaaaacaatgtcgaatattaacaatttaaagaattataaatcatgaaacagacaacaaagaacattctgggagtaggagcaatcattcttcttagctcaggagttgcaggattgacaacttacaaattgttgcaatctaacgaatctgcaaaagaaacatcttttaatgagatgttcaagcagaatcccaatgtcaaattggctgcttttgacgctgtgaacgctcaacctgttgatttgacacaggctgccgagaattcacttcatgctgtcgtacatataaggtctactcaagaagctaaaacaagaactgttcagcaagcgccggacattttcgatttcttttttggtgatggacgcggacagcaacgtcaggtacagtctcaacctcgtgtaggttttggttcgggagtaatcatctcgaaggatggatatatcgtaacgaataatcatgtgattgaaggtgcggatgaaatcagtgtgaaactgaatgataaccgtgagtttaagggacgcgtgattggtactgaccctagcaccgaccttgcgctggtgaaaattgagggtgatgatttcccgactattccggtgggagattccgaagcgttgaaagtaggagagtgggtattggcagtaggtaacccgttcaatttgaactctactgtaactgccggcatcgtaagtgcaaaagcccgttctctgggagtatataatggtggtatagaatcattcatccagacggatgctgccatcaaccagggtaacagtggtggtgcactggtaaatgccaaaggtgaattggttggtatcaattcagtgctttcttctccgacaggtgcttatgcaggatacggttttgctatcccgaccagcattatgacgaaagtaattgccgacttgaaacaatatggaacagtacaacgtgcattgctcggtattcgtggtggctctatcggtagcagtttgatggacgaccgtcaaccgattgacaaatccggtaagacattggcagataaagctaaagaactgggtgttgtagaaggagtatgggtttctgaaatcgtagagaatggttctgctgccggagctgatatcaaagtcgatgacgtaattatcggtgtggataataagaaagtatccaatatggctgacttgcaggaagcacttgctaaacatcgtccgggtgataaggtgaaagtaaaactgatgcgcgataagaaggaaaagaccgttgaagtaacgttgaagaacgagcaaggtactaccaagatcgtgaaggatgcaggcatggaaatcctgggagctgctttcaaagagttgccggatgacttgaagaagcaattgaatctaggttacggtctgcaagtgacaggagtttcttccggtaagatgtcagatgcaggagttcgtaaaggcttcattatcctgaaagctaatgaccagccgatgcgcaaagtcagcgatctggaagaagtaatgaaagctgctgttaagtctccgaaccaggtattattcctgaccggtgtgttcccatcaggtaaacgcggatatttcgctgtcgatctgactcaagagtaatatataaaaataaggtaagaagattgcaggataagctaatgaaatagaaaaaggatgccgccaatcaacttgtcggcatctctttttgttttattagatgaaaaatatagtgtaaaagttacttaattttgtatgttaacaaattatttgtcgtaactttgcactccaaatctgtttttaaagaatgagacaactaaagattaccaaaagtatcactaacagagagagcgcttctcttgataagtatttgcaggaaatcggccgtgaagacctgattactgtcgaggaagaagtggaactcgctcaacgcattcgtaagggtgaccgtgtagcattggaaaaattgacacgtgccaatcttcgtttcgtcgtatctgtggctaaacagtaccagaaccaaggtttgagtttgcctgacttgattaatgaaggcaatttaggactgattaaggctgccgagaaatttgatgaaacacgtggatttaagttcattagctacgctgtatggtggattcgccagtctattctgcaagcattggcagagcagtcgcgtattgttcgtctcccgttgaatcaggtaggttcgctgaataagatcagcaaagccttctcgaagtttgaacaggaaaacgagcggcgtccgtctcccgaggagttggcagacgaactggaaattccggttgataaaatctctgatacgctgaaggtatccggccgtcatatttcggtggatgcgccttttgtggaaggggaggataacagcctgttggatgtgttggttaacgatgattcgccaatggcggaccgctctctggttaatgagtctcttgcgagggaaattgatagagctctttctacgttaaccgatagagaaaaagaaatcattcagatgtttttcggtatcggacagcaagaaatgacattggaagaaatcggcgataaatttggcctcacacgtgagcgcgttcgtcagattaaagaaaaagcaattagaagacttagacaaagtaatcgtagtaaattgctcaaatcttacttgggataagtaaggaatatcagtttctgaaagaaaaaagaatttgagtcgcataagtcgcacttttcatatagaagaatgtacttatgcgactttttacataagccccattctataattcaatcttatactatgcgagttttatgaaaaagtcagtttttaatatcattggttcttattgctttgggagcagggctggtggcgtatgcaagatgtgcggcatccttttctgattcggtgcctgctaaagtagagcagcgtttgcgggaaaaagcacaggcgggaaaggcttattgtgataagaatggatataatacgaattattgctttctggtagatttcagtattcattctggtaaaaggcgtttctttgtatgggatttcaaaggagattccgtgaaatatgccagtctctgtgctcatggatatgggaaaaatagcaccgtgtccaagcctgtattcagcaatgtggaaggtagctattgctcttctttgggaaaatacaaggtgggtatccggtcgtatagcaagtggggaatcaatattcattataaattacatggattggaagcgacgaatgataatgctttcaagcggtatatcgtgttgcattcttatactccgttgccggaaacagaggtgtatcctttgcatcttccgttaggaatcagtcaagggtgtcctgtaatatccgatgaagtgatgcggaaagttgacggtttgctcaaagcggaaaagaaaccagtcctgctatgggtctatgactaagaaatgctatttatttgagataaatagaggtaatctcctcttttttgttacctttgcaaggttaaaaattatatgatatgaaatacgtaaaaatactatttgcaattgcacttgtgtttaccatgtgctccgctttttccttgaaaaaagaccactctaaaccggtttatgcttttggaatttctgcctcatttacggatacagtagtctatttcacggacattcagatattagatagtgcgaaggttagcaaggaaggcttcttgtctcaccgtgagttgtatagttatcagttgaagaattatctggaggataaccagttgcaacagaatagtacatgtatgatttacttctcggaaaacaagaagaaattagaaaaagaagcaacgaagattctgaataaatacaagaaaaataatagaatgacggtgtcgcggattgattctgataaattccactttacgaaaccggaagaataataagcaatagttaaattgttaatataataagagatgcagctttgcatctcttatttttttatctttgcctcgtaataaacttgaaatctaatgaaaaagataaaaatattctccttgtttgtgtgtttggctatgctggtaatcgcttgtcataatgacgatgatgaaagaggagtccagatgcgtacagttcttgtttatatagcaggtgacaattctcttcgcagctttgccacagaggatttggcggaaatgacagagggaatgcagtctgtagatgataactcttataacctactcgtatacattgataccggatcaagtcctaaactaattcgattgaagaaggataaaaagaagaatgtcgtacaggaggtaatcgctacgtatgaaggacgaaactctgtagatgtctctaagatgaaggaggttatcaacacggcattttctgaatatccggcacagagttatgggttggttttgtggtctcatggagaaggatggttggcaaaatcgcagaataaaacccgttggtggggacaggatggtggttcaaattacatggatatttccgagttaaaagatgttctgcgtaatgcgcctcatttgagttttcttcttttcgatgcatgctttatgcaatctgttgaggtggtcaatgaattgaaggaacatgcggattacataataggctctccgacagagatacccgcaccgggtgctccatatcagaaagtagttccggctatgtttgccaataatgcatcggctacggacatagcaaaggcatattttgaattttatgcagatgaaaatctttatactggcaaattgccatataattggggcttaggtgatccctggacggcaggagtctctgtttctgtagtgaacacttccatgttggaacaactggctaaaagcagtagtgagattattccgaaatatattaagggcagacaagcgatagccacatcgggcatactctgttatgattgtcggtccagtaagtattattatgattttgatggattaatacgttctttaggtagtgagactagcgaatatgaggcttggaaagctgcttatgatgctgctgtggtttattggaagactactcctaataattactccagttatggcggtagtttctcgatgaatggctctgcaggactttctacttatatatttcgtcagtcgtatgaagaggagataaatcctttttatcgtcagtcgatacaatggtactccgctgccggatgggatgagacaggctggtgataattaccatttcaatattctttagaagataggattctaactttttgtgaagatagtgtgaagaataagcaatccttatataagtggttatatgagacgtatgagaacgatttgttttcatacggcattgcttttggcattagtaaagaacttttagaagatgccattcacgatgtttttttgcatttatatgagcgtgagcacaaactttgggaaagtcagaatatgaagttctatctgttgaactgtttgaagaaccggattcggaccattaagaaaaaagaaatgaataccgaatttctggaagaaggttctgataactatagtttccttattgaagtgaacggctttgaactcatagatgaagaaaaagaaagagccgctatgcaaaaacagctgaaaaagatgctggatagccttacagaccggcaacgggaggctgtatatcttcgttatacccaaggacttagctatgaggaaatcgggaaattgatgggaatacaacctaaagcagcacagaaattagtgtatcgggctatcgaacaaatgcgtaaaattcagcctcaaattatttattttttccttttcggttattttctttaattttcgtgggggtatttttgttctttgcgtgtttttaaagtgaaaccgtaaaaagaacgagtatgcattcagatcgaatacccgaatcgacaaaacaatggctacaaaatgaagacttcatattgtggtgtctggctcctacccaggaatcggaagaatggtgggttaattatcaaaaagagcatcccgaagatcaagcatccctacaggaggcccgcaaaatcatattatctgcccggctgaatccggttcagcgcttacccgaagaatcagaaagattgtgggcacgtatagagacaagcatggagcgtcgtgataagagacatcgttttatcttatttacccgttatgctgccgcctgtgtactaatattaggtattgtttctttctggttgattcattcttttcagacgtccggaactgctgatgatctgcttgtcaatgtgaaagcagatactctgtatcagaaagtaatgctgataagagatgatgcggaagcgattcagatagagaataatgccgtcattacttatgatagcaatattactattcaatccgatggtaaggaaacagagataatcaaagagggagcggttcaacccggaaaacaaaatacactgatagttccttatggtagccattcatccattgtattggcagacggatcgaaagtatggattaattccggaagtaaattacgtttcccttcctcttttggtccgggcgaacgcaggataaaagtagaaggagagatttatatagaagttgccaaagatacttcccggcctttttatgtagagacaccccaactgacagttaatgtattgggaacaaagtttaatgtgtctgcctatgctgatgatgcattgcaatccgtggtgttggtagaaggaaaagtaaatgtaaaagcaaactccaatgaagattttgtccttttgcctaatcagcgttttaagttgagtgatgggatatccggcatcgacgaagttaatgcttacgattatatttcatggaaagatggcgtacttcagttccggggtgagacaatgaaagatattatccaacggctaagtcgctactataatgtatctatcacatgtacgccggaagttgcgcaaaagtgtacaatgggaaaacttatcttatttgatgatatagaacaagtcatgaaaaccttctcgttgctgtacgatgtccagtgtacaattgaagcgggaagtataaaaatcgagtaataaccctaaaaatttaatgcctatgaataaaccacagaaatgaagcctttgtaaaaaagaagttcggaagagaggcaactcttccgaacccgtgagatttaaatttttcaattacttatgaaaaacctaaaaattgatacgcaaaaatatggaaaattcctattacaatcatgcaaatagggcatattttctttgtaaatcatatctgtttgtgaaattttttgttatttttctatttatagcgaatgtaactctcgctaatggaaatggaacgagcgaactctatgatataaagaaagggactctactggaatattttaaagatatagagaaagaaacaggctacgttttcatctattcgaaagatatccgacctagtttaaatcaagttgtcagtgtagatctatccaggaagaagacaatcacagaaaaattgtcagccttgtttgaaaagacaaatctggtatatgaaataaatggaaaacagattgttgtaaagagaaaaacggcagtgaaaaagaatctttcttcgcagccacaggagcctcggagaataaccggtactattaccgatacaaaaggagaaccgattatcggtgccaatatcaaggaagtcggtacatttaacggcataatttccgatataaacgggcgctttgccttatctgtaaatccgaatgcagttttggaaatcagttatatcggttatgtcacgacgacagtacctgtaaaagacaataaagtgctttctattgaaataaaagaagccgagcaaagtctggaggaagtcgttgttgtcggctacggaaagcagaagaaagaaagtgtgacagcatctatcgcttctatttcgaggaaagaactggtacagacacaacaatccaatattagtaacatgctggtaggacgaatgccgggattgattgcttttcaaagaagtggtgctcccggcgaagacgcttccagtctgttaatcagaggtgtcagtacatttacagacaacacggctcctttaataatgatcgatggcatcgaacgaactaattttgacggcatagatccgaatgaagttgaatcattgaatatacttaaagatgcttcggcaacagcgatctatggagtaaagggagctaacggcgtagtattaattactacccgtaaaggggaaagagggcgtccccggttgagctattcgggtaattttgctttgcagcaatctacccagctccccagttatctgaatagtgcggattatgcaactttatacaatgaagctttagaaaatgactcccgggtttcgggttctacctaccaaccgaaattcacggataaagatattgaattgtacagaaatggctttgatccgattttgcatccgaacactaactggatagacgattttcttagaaagttttctacccgcactcaacataacatcaacctttcgggtggtacagaacgtgtgaaatactttatatcgggaagttatttcgatcagaccggtatctataaacataccaagatagattcggatcatgatgtaaatccccgtaacacccgttataacttcagaactaatttcgattttcagataacgcgggacttttcggcaactgttcaaatggccgcccagataggtagagtgattactccgggctccggtaacagtggaatctggcaagctatttcttttgccaatcccttgagctctccgggattggtggacaataaaattgtccgcatacaggatggattgggaagcgtcaatccctggcaaaccttattaagcaacggttatcagaaagataatagaaataacatcaatacaacattacgtctgaattatgatttatcatctttgctgaccaaaggtttgtccgtacacgggagtatcgcgtatgatagctattattacagccgtaagaaatattcgaaaacctttccttattatcttgcgcgccgtgatgcggaagatccggattacatctatctgatcccccaatcagaagagagtatctggtctgtaagtaccggatgggataagaaccggaaagtatatatggagtttggaattgattataatagaactttcgggcttcataaaacgacagcacttattctgtataatcagagtaaatactattccccctcccttcaatattatgtacctaatgcttatcagggattggtaggacgattgacctatgaatatgcctcccgttatttggcagaattcaatatgggatacaacggaaccgagaattttgccaaaggcaaacggttcggattttttcctgctgtttcattaggttgggtcatcagtgaagaaaagttttttccgaaaaacaatatcgttaaatatctaaaggtgagagggtcctacggagaggtaggaaacgatcagataggtggtgatcgatttttgtatctgccgtcttcttatggagcagcgagcgattcgggtgtgaacaagtataatttcggtttggcttccaatccgtatacttcactgatgattgttgaaaataaaatcggtaatcctgatttgacttgggaaaaggcgaaaaagatgaatgtcggtgtagatattaatctgttcaataattgtctgactgcttcatttgatatattcaaagaaaaacgaaataacatattagccaacagatcaacatcccccatgattataggcgctaatcttcctgcatataattttggagaaatggaaaatcgcggttgggaaatggaccttaattttagacatcatatacaagatttccattattgggcacgcttcaattattcatttgcgaggaatgaaatcatctacatggatgaagtgcagaagagatatgattatcagatgactaccggaagaagaaagaatcagtttttcggactgatttttgacggatactataactcgtgggaagaaatcaatgcattagaccgtcctaaaagttcatggagcgggaatcagttgcaaccgggagacgtcaagtatatagacgtcaaccaggatggagtgattgatgattacgacatggtcccgataggatacacccccgtaccggagattatttacggtttctcattcggagcgcaatataaaggatttgatttctccatcttatttcagggagccgacaatgtatccattaaatatttcggacggtcgatgtggcctttcgcgaaaggagaagagagtgcgaaatctctgataaaagaacgttggacacaggaacggtatgaggcaggagaaaagatcacctttccccgtttgtctctgaatcccaacggagaaaccgatcacaactatcgtccttctactctttggatacgggatgccagttatttgcgattgaaaaacctcgaagtaggatatacatttaccggaggttttgtcaaacggcttaacctgaatagtgtaagattatatttcaacggttccaatttattcacgtggacagatgtggtagatctggacccggaagcaccttcgagaagtggaaatgttgaaatcaatacatatccgttgcagaaagtatataatattggtcttaatataaatttttgataatcatgaaaagaataacatatatatgtgcaatacttctgtcgtctgtattgatgttttcgtgtagtgactatctggaagctccgccctctgtcgatttggatgaagacggtgtctttgccgacaggactttgacagaacaatacataacaggcatctatgcagaaggtatgccgctggggttctcgatgggaagtagcgggatcgaccgtaaactgtgtgcaacctcaaccctggcaggagcgtgtgatgaagccgaacaaggtgcaaactgggggaagggcaatgcctcgtggaacgtggacaatcataacaacagcagcatagactgggatgaagacccccgtcacaacacccgttggcagacattacgaaaatgcaatatcgtgcttgaacgtattgacgaagtgcccgatgatccgggagacgttgattttaagaaacgttccagaggcgaagcctattttatgcgggctttggtcttctgggaaggagtatatagatatggtggactgcctataatataccgtagaataaatccgtcggaagatggtaaactaccccgtaatacattttccgattgtgtagactccattcttgtcgattgtgaccgggctgcctccatattaccggattattatacgaattcgatattggtgggacgggcaaacaggatagccgccttagctctcaaatccagagtactcctgtatgcggcgagtcctttgttcaataccgacgatccgtaccttcctttaagtggaaataatgacctgataggatatggaaactatagtaaagaacgctggaatgaagctgctaaagcagccaaggcagccattaccgctgttgaatcttctggctattatgacttgtacgatgagggaacacctgaaacaaattacgaacatgtgtggactgctcccgataacaaagaaataattctggccaacaagaaataccggaatttcacaacaagcagtcatcccataacaagcaatataccggcatgggcgggaagtagttggagcgacggcggtctttttacaaccttcaatttcgtgcgtttctatgagaaaaaagacgggaaccaacaaacatggaatatggatggtggcgatgatctgcttgaaaagtacgacgaactggaccctcgttttgcgcaaaccattgcagcacatggagctaactggaatacagagattggaattcttaattttctgcccggtggagctcacaatgtagccaatgataaaacgaaacacctggttcgcaaatgggtacctcgcgtactaagagcaacggctccgcgcaactccactaatatggactggattgtcttccgggtagccgaactctatctgaattatgcagaagctttgaatgaatattatgaaactcccccgaaagaagcattcgatgcagtcctgaaagttcgtgaacgctccggaatgccgggctttccttccactttgaataaagagcagttcagggagaaactgcgaagagaacgagccgtggaactggcttatgaagatcatcgtttctgggatatacgacgttggctgatagccgatgatgaaggtgttatgaaaggtgccatgtatggattgcagctctccgctgttacaggagcaccgggtaaagtacattacaaaccttatgtctttgaaaacagattatggagtgaccgttcttatttacatcctatcaagcagaccgaaatagataaagggtatatgcttcagaatccgggatggtaaatatgttcaatcaactaaaaataaaaggtatgacaataataaacagtatatacaaagggaagcgttatgctatacttttgactactattctcactttttatgctcccgttttgtttgctcaacacatagccgactctgcacttgtagaagtcgccaatgggcaacaaccggaatggaggcgaacaagtgccatttcttccatacgtggggaagatttgatgaaaactacttccgcaagcttgggaaatagtctgcaaggacagcttcccggactaacattgttgcaacaaagcggagagcccggctatgatttctctatcgcgaatctctacctccggggacgtacttcctatgcaagcggacaaaaaatgctggtatatgtcgacggtttcgaagccccgattgaaagtctgtccactgcggaaatcgagtctgtaacattattgaaagacgcttcggctctggctttatatggtatgcgtggtgcaaatggtgttttattggtgacaaccaagaaaggatgcgtttccgctccgcaagtcagtatccgtttacaaacgggaatacaacaaccgttgggcgttcccgatcctatcaatgcgtatgattataccaccttatacaatcaggcgcgtgtgaatgacggattgcctcgtttatacactccagaggaattgaatgcctatcagaacaacaccgatccttacttttaccccaatgtaaactggaaaaaggccattttgaataatacagctcctttgagtatggctgatttaagttttaaaggaggaggagatgtggtgcaatactatgtaatgatgaatcttttgcagaacatcggtttctacaaagacaccgataaaaaacgccgggaaaactcgaatgcctattatgcgagctttaatttcaggtctaatttgaatatccagataagcaaacacctgtctaccggactcaattttagcgggagtgtaggtaatcgctctattcccggaggcagcagttctgccaacggacttttgggagcgatatggagaacagctccgaatgcatttccggtgtacaaccccgacggatcgtatggaggaaatgccgcttttaccaacccggtcggtaatatcgtcagcagagggctttataaagaaaacagccggactttccaactgatttttatgcctaaatacgacctggagaaactgacaaagggattaagtgtcagtgccggtattgcctacaacaactatatggcggattcatctataaagaatcagaattatgcccgttattctctttccaaaggagcagggggagaggtgctatatacaccctacggcgctgattctcctttggaatccgatgaaggattccgtacagactggagtcgtctgaactttaaggcacagttggattatgatcgcgttttcaagcaacatcaactcactgccagcatctttttcctgtctgatttatatcagaaatatggaagtcgtgatgacattaaatacttgaattatgcagggcgggtaacttactcttataatcaaaaatacataggagaatttgcagcttcatatacaggttgtgatgattatgctcctggaaaaagatatggattctttcccgctttctccgccggatggatactgtcgaaagaaaacttcatgaaaaatatcaactgggttgaatatttgaaactaagagcatctatcggactggttggaaacaatcagaatgagaacggacgttatctgttcgaccagacttatagcagtaacggctcctattttttaggtacagggtcgtcatcaacaggcgggtttcgggcagatatgattgccaatcccgatattagttgggagaaggaacgtgtattcaatatcggattggatgcagttttactgaaagggctgtcggtagaattcgattatttccataaagaaagatatgatatcctgtcacagccgtattccactattcccggatttgttggagcctcttatggcgacatattgccttatatgaatgtaggtaaagtaaagaatcaaggtttcgagggtacgatcaggtacgaaagcagtcttaaaaataacttcaactattacgttgaaacatcggcgtggtatgcaaagaatgaaattgtcgatatggcggaagaagtgaaactctacgattatcaatatcgtaaaggacgttccgtgaatactccttttgtacttgttgctgacggactgtatcaggagagtgatttcgattcgaatggaagtctgaagtcacatttaccggtaccgcagtttggagaagtaaaccccggtgatataaaatatatcgataaaaatggtgatggagtagtcgattccaatgactcctatcctgtgggatattctaatattccggagtggaattatgctttgaaaataggctttgaatggaaagggatagacgttgaggctttatttcatggcgttgccaatagagacatctatttgagcgggccgttggcttattcctttaccgacaatggctctgcttcaaaactggctctcgacagctggacaccggagaatcccaatgcttcttatccccgtttgtctacccggacatttgaaaacaattaccggatatctacatattggaaaagaaacggaaactacttcagaatgaagaatatccggattggatataccttcccccagtcaatagcaagagcgataaaattgtccagattgtatgtgtatgctaatgcgagcaatcttttcaccgtgagtcatcttgacggattggccgacccggaaagcagttctttgattacatatccgttgacacgttcctacaacctgggaataaaaattgatttttaataggtaagaacaaaaatataataattatgaaatacccaataggtttatctatcatattgaatgctcttgctgctatcagcatattgtccggatgcagtgattatctggacagagagtatgattcgtttatcgacaacgagatgacctttacttcctatgaacgtacaagcaaatttctagtcaatgcttatcggtatctgcctgatggtttcaaccgtatcggttccgaagctatgttggatgccgctaccgatgatgccgaacatgctaatgcctcctgcaacatccagcacttcaacaccggagcctggaattcaaggtccaatccggatgatttgtggaataagtattacgcaggaattcgcatagcgaatgaatttatagaaaatgtagacagagtgaatctggataaatacagactcgatccggataatcagaatgaatatcagaaccgtctgaatgacttgaaaacatggaaatatgaggcccgttttttaagagcgtttttccatttcgagctggtgaaacgtttcggacctgtacctgtgattacttctacactatccgtcaatgcggattattcggagactccacgcccgtctatggacgattgcatctcattcatctccagcgaatgtgataaggtagccgaagtgctcgatttaactccgggacgaggaatcgattcggatttgggacgtgcaacgaagggagccgcattggctttgaaaagcagagttttattgtatgcggccagtcccttgtatctggactggcagaatttttcggaaagcgatcttccttccgatatggagaaatggaaagctgcggcacaggctgcgaaagacgtaattgatctgggcatatattcgttgtatggcagttatgccactttattcaagaataactttcagaattccgagtttattctgatgcgtcgttatggaaacaattccgactttgaaaaatacaactttcctgtcagttatggtggggtaggcggcatcaatccttcgttgaatctggtagactcttatgaaatgaaagatggcagctattttagttgggagaatgaggaaaatgccgttcgtccgcaattctaccgggatgacaggttgaatgctaccattctgctgaatgattccgtttggaaaagcacggcggtagagaattgggacggtggaaaagacggtctgggcgttaccaatgcaaccaaaaccggattctatctgaaaaaatacctcaatgaagatgtgaatatccaaaccggcggaggaagtcagggacatatctggccgttgtttcgtttagcggagatttacctgaattatgcggaagccttgaacgaatacgatcccgaaaatgcggatatagcagaatacgtcaatcgagtgcgcagccgtgccggacaaccgaatctgccttccggattgacgcaggacgaaatgcgtgagcgtatccggcgtgaacgtcgtgtcgaactggcatttgaggagcatcgttcgtgggatgtaagacggtggaagattgcgcaagaaacactcggaggagatttgctaggtcttgaaatcacccgtaagaatcaggctcgaagagctgttacccggaattccgtaataccggctaacgaagttccggaaggatggcattattacgatggagacgaattcaatgatttggtcataaacaactcatattggggacagtatggaagcgacactccggtaggaaactcccagtatggacaacccaccggaaatatccagacttatcgtaaaaaacagattacgattgagaaagggagtggcggattgagctttgcccggatagcagccaccaaggacgacaatccaccggctccgacattaagcactgccagtacgagagaaggatggtggtcgggagctttgtccagccgggataccgacaaatatggttatcaggggaaatattaccctctgcattcccgcattgagattcgtgcaaaaataccttatatatatggtatatggatgggaccgtggtgtcgtcattatgcaggagccagtgttgcggaacttgacatcgaagagtttttcgtcaaggaatttgagaatacggcttcaccccgccggcttagccaggctttacatttgcatgataataaaacaggcaatctgggaatcaacgtgaatgggtacggacgacatacagtgcttgattttgatccgggagcagacttccatacgtatggcgttcaggtagatccggacccggtttctccggataagcatgctatcatcagctacctgttggatggtaaagtaaccaatacattcaagacgattgactatgatgacagatataatacatttataaccaaagcaatagcggagggaagagaaaagcgaacctgggacattgcgataaccggacaaatcggaggaaagaatgaaaatggtatcggctatcccgaagacaggaatgccaatttgagaaacgtttcgatggatgtagattgggtacgtgtatttacccgggatgaaacagaaccagagattcctgaaaagccggaatatcccgtcgagaagtttgattattcccgtgctgtggtagaaaagagagtgtttgattctaaaatgtattggtatcccatacctgaaagtgagattctgcagttgaagaactggaaacagaatccgggttggtaaatcattaaaaagaaatatcatgttgaaaataaagattctaataatcatattttgctgtatcggggtggtgaaagcccaaaccgttattcctccttcatcagaaacccctcccggatggatttattacgatggagacgagtttaacggagatgtgattgactcccggtattggggaatatatggttccccaaaagtggggcgacccacctataatcaggaaaataaagccatgcttcagacatatcgtccggagcaggtctttatcgaaacccttcctacaggagagaagatttgtcgaattcgctcattcaaaagtaaagatgcgcccagtcccgttcatcccagtgtgaagagtaagaccggatggtggtcgggagcgctgtccagcagagattccgatacggagaaatattatcctcttttctgccgcatagagatcaaagccaaagtcccatatctatatgggctttggaatgcactttggttgaggcattataaaggagctggagtagccgaaatagatatactggagttttttaccaaagctttcggggaaaatccttatccggccaaagcgaatcaaaccttgcatttgttcaattcggaaacgcaaaagttgggaatcaatctacccaaaggtcagatacgatatactgaaatcggagacgataagccgggagataatttccatgtatatgcggttcagatagatcccgatcctgttgataacaatcatgccatcattacgtttctgatagataataaagtcaattaccagatacatacccgtacacagttgggggatgcatatactgattttatcactaaggctcgtaaagaggatcggctggacagagtttgggatattgctatcaccgggcaggtaggagcatttgacaagttggatgtcggctatcctgcggaggaattgcagcaatttgatttcgatattgattggataagagtttatgttcgcgatccgcatacccggatcgtcggaaatagtaaactacctcatactccggaagcggattcatttgttaaagatttgctctcacggatgactgtggaagagaagatcggccagttatcccaatacgtaggccgtacccttttaaccggtcctgaatcagaatatttgagcgattcattgatagcacgcggacttgtaggttctgttttgaatatatccggtgcaaagacattgcgtgatttgcaggaaaagaatatgcgtcattcccggataaagataccgattctttttgggctggacgtgattcatggatataagacaatctttccgactcctttggcggaatcgtgtagttgggatttagcagcgatcgaacgagctgccaagattgctgcgattgaatcctcggcagccggactacattggacgttcgctcctatggtcgacatcgcaagagacgcccgttggggcagggtagtggaaggagcaggagaagacacctacctgggaagtgaaatagccaaagcaagagtgaatggttttcagtggaatctttgggagaataattcagtattggcatgtgcaaagcattgggtagcttacggacttccccaggcgggaagagattatgctccggtggatatgtcggaacggactttgtttgatacttatctacctccttttaaggcttgcattgatgcgggagtacttacttttatgagtgctttcaatgatataaatggtattcctgcgtccgcacatccgttcctgctcaaagacttattgagagggcaatggaatttcaatggttttgtggtaagcgattgggaagcagtgaagcagctggtggcgcagggagtggcggaagacgataaagacgctacccgtctggctttcaattccggcatcgacatggatatgacagatgggctctataataaatacatgaaagaactgatagaagccggtaaaatcagtatggaagatgtcgacaattccgtcagtcggattctgcatatcaaatatgctttgggactgtttgttgatccatataaattctgtaatgaagaatacgaatcgcagacaatcatgaaaaaagaatttctggatgcagcactggacatggctcataaatcggctgtcctgctgaagaatgacaatcatacattaccgctggcaaaaaatgtccgttccattgccgtggtaggtccgctggccgataatcagaccgaactgctgggctcgtggagagcaagaggggaagatcgccatgtgacgactgtattgcagggcataaagaacaaaatcggcggtaacaaaacgaaagttggatatgcccgtggttgcgattttgacggagaagataagtcaggattcaaagaagcagtgaaattggcttccaaaagtgatatggtgattgccgttgtcggtgaaaaagctttgatgagtggcgaatcgagaagccgtgcccaactggatttgccgggtgtgcaggaagaattgataaaagaactggttgccacagggaaacccgttgtcgtcgtattgatgaatgggcgtccgctgtctatcgaatgggtggacaagaacgtatcggccattctcgaaacctggtttttaggtacttctgcaggaaccgctattgctgatatactgttcggtgattataatccttccggaagattgaccatttcttttccacgggtagagggacaagtaccgatttactataactataagaaatccggacgtccgggagatatgctccattcctcaaccacccggcatatcgatgttccgaatgctccgctctatccttttggttacggtttgagttataccacattcagttattcagctccgcagagcacccaaaaagaatatacgcgacaggagaccatctccgtttcggtgacagtaaccaataccggagacagagatggcgaagagactgtgcaactgtatgtgaatgataaagttgcttctgttgtgcgtccggtaaaggagttgaaggcattcaagaaaatattcctgaaagcgggggagtcaaagaccgttcagtttgacatttctcctttagctttaggcttttatgatgctgccatgaactatgtggtagaacccggtgaatttgaaattatgaccggctgcaacagtaatgatttacaaaccatatcggtcaaactaataaattagaaggaggaaccgttctatgagaaattggataattgtattttttgtcatctttgccgctcggctttctgcacatgacggtgacagtataaagatcacacacggtccttacctgtgtgatatgagtaccgacggcgtgacagtggtatggactacaaacaaacctgctctttcgtgggtggaagtggcgcctgccggtgaagatcatttctatgggaaggaacgtccgcgatattacgatacggagtccggacgtaagcgggccaatgatacaatccaccgtgtacgcatcaaacatttggaacccggcagggaatacagataccggattttttcgagagaagttgtctcctggccttcgagtgactgggtaacttatggattgattgctgcttcaaatgtatacaagcaagaacctttcagattcagaactttcgacgaccggaagaaagaaatttcctttctggtattaaatgatattcacgggcggagtgactatatgaagtctctgtgtcgggaagtagatttcaaatctcttgatttcgttttgcttaatggagatatgtcgtcatgggtagaggggcaggagcagatatgtaaagattatattgatgcttgtgtcgaattgtttgcgtccgaagtgcctattgttttcaatcggggaaaccatgaaacacgtggagtttattccgatgcgttgataaagtattttcctacgtctaccggaactttttattatcgtttcaacataggtaaggtttgttttcttgttcttgattccggtgaagataagccggattcggatttggagtatgccggtattgccgactatgacaattaccgagaagaagaaaccctatggttgcggagtgtggtggaagaaaacgattttaagcaatcatcccttcggatcgcattcctgcacatcccgccgacgataggcaactggcatggaaactatcatttgcagcaaaccttgttgcccgttttaaatacggctggaattgatctgatgttatccggacacactcataaatattatttccgtgaatcagaacccgataaagccaactttcccatccttgtcaatgataataacagctatctgctttgtaagataaaagatggaaaaatggtgattgatgtggtaggagcgaatggaaaagacaagaagcaacatcagtttgatgtgaaattttagtcaaataccattagattccaatagtatagttatttataatttaatgtaatcatgaagatgaaaactataataaaattattatttgtattttcgttgccatttattttctgtcgttgtgccgacgacgggatacactatgaacgggaaatcaatgttcccgaaggtatctatctgacggggagtgcgtcccaattctcggtagaggcaatcaatggtaaaatgaatgtgataaaagagggcactttggtcgcattgaacacatggctgacatccagcggagatttttatatctctttagtcggaccggatgggcaacccgtttattatgggcagggagcgcttttgcaaaacgacaacagtgaggtgccaacttattctttggctcctggaaccggcggtttcagagtaatggaagatggattgtatcagctaattgtgaatcctttattgaaacaggttaatattgttccattcaatttccgtttgacgagtaaattcgaactgacagaagacggtgaaaacgaactctttcttcaaaaaccgtcttacgaccatattaaccatgtggctacctgggtgtccagtggcgagttagaagtgatattaccggcagagttttcgtttaattataccgataatacgtcttttgatgtgaaggaaacagatacggagaaatatacattctcttctatgtacaccggaacgggaggaagtataaaaatgaatgttttaactgaagaatatgccgaactaaccaaccagtcgcaagtgcagctcaatcttaaaaacaaaggtgagtataaagtaacgcttcaatatgaagtcttgacaggaaaattctttgcgaagatgacgggcaatgagatcatagaacccgaaccggaggggtatccagagaaactatatatgattggagatgaatttggaaactggaattggaattcgacaaatgtggtagagatggcccctgtgggacagcttggcaatggtgcattctggactatcaagtatttcaatgctggtcagggaattaaatgggcatcggaaaaatctgatgcggaaagttttgcctctttgggtacaaatgtcaattatgttgtaggcagtaacggaagagcgacggtagaaacaagcggcctgtatttggtatatgtagatatgaaccgtaatcttataacttttgagaaacctgccgtttatggaataggtgagtgttttgacggacaggaagtatcgttcgatctttccgggcagaatttctctgctgtcactacaacacaaggcaatcttcagatgtatgcaacttccgactataacaatagagactggaacactatggaattcaacatctataatggacaaatctattatcgtggtgtaggtgctacactggaaccggttcctgttgcttctaatataccaatagaacttgatttctctcaagataaaggtaaaatagctgtgacttttgcctctccaagtgatgtcccctcaacagcgaaggctatttatatggttggcgatgaatttggaaacatgaattggggctcggatggggttatctcattagataaggtttggaacagtgccgaccgatggatacatattaattatttcaatgccggaactaaacttcgtttctctacatccaagatatttggtgatggagagtttaccggactgactaataatgtgggcttcgaaatctctgacgaaggactggtggttatcccccaaagtggtacttatatcattttcgttgatttaggttcgaagaccatctccatccaaaagcctgtaatctatgggtatggaacggcagccggaggaaacaacgaaaagatcttgccttttacggaaagtagcgacgggaaaacattctctgttactttacctaatggaggacgtttcagaatacatccttatattcctgcttttgataatcttaatccttcatttggtgcttggaaacgcgaatatgctgttaatccggagactcttgaaatctatttgcgtaaagagggcatggatgaaccgaacaaagattatgtatgggctgccaacactataataactcttgatttcagggcagcgaaaggaacgatagtagttccttagcccggtctgctccaagaaaaattgtagctgattatatttttatatcacttttaccctcacaccctcacaccttcgttcaatccctttattcatcgtggttgcaaggtgtgagggaacgtgtggcagtagggtgagggtaaaaagttaccctcaccctatttaattttagttttacttttaatttgttgatttatagtgaaatacacttctgcttggatgtaaataactaatctcatatctcactattttgatcctttttctatcatataaatgccgaaagtgtgtcattagtatctgcttttgaagtaccgtctcttattctatattctttcatcaattataggttaatacctaatgatctttctgtaaactcttaatgcttcttatgggctcactatagtagatagacttgtttacagtagtgagcttgtttgtctacatttgatagcttatttgttcacattggtgagcccttactaatcactaagcgagaatgtatactattctcgaacatttccgttctgcactctgtaatctgaaaaaggaggtattgacctaagtttaaataaatgggttgagttggtgagtctttgtactacagatttttcccttacaggcatcttcttgctttttcctttttcgcctttacgcgcccgcgtgtaatataataatgtgtatccctctcgtcgtttccgcacacaatttccccatacataaaaatatgttctacaacatcgttatgcgtcagcactttagcaaatgtattcaaaaataattagaaaaaatagtttgatatatttggagtgtataccaaaagggcgtacttttgcacccgctttccaagagaagaaagccttgacaaattgacttagtgaaaaagtggaatctcacttaaagaaaagaacaaaaaacttccgaaaaagtttggattataataactaaagttcttatctttgcagtccgatttgcaaagaaaattggcaagagttattctttcataccttctttccctttcgcatagagagccagagaaaccagcgtaaaaagaaaaactaaaaaaaacttccgaaaaagtttggtagttaaaaataaagtccttacctttgcacccgcttttaaaacgaaagcaacaagttctttgaaatattgataaacaatacaagtagtacaggtaaaaaaatagaaccgaaaaatatttgtcacaacttttacaggaaaataatttttaatgcgtctgccctgcagctgtcagacgattaattacctgcataaacaaatctaaattataagaataagccgattaaatcctacgaacaaaaaaactaattctttaaagaaaagcgattatctttcacagatataagaatttttaaatagcaaatgctaaatcattcaaataaaacacgtacttttgcgattcataaatttgcaattgattgaaagctaaaaccatgaaggtgatacatttcaatcgccaacaaaaaacattatatggataaattcagttactctattggcctcggaattggtcaaaacttatcaagcatgggaatcggaaaccttgcggtagatgatttcgcacaagcaatcaaagacgtattggaaggcaatcagacggctatcagccacaatgaagcccgcgaaatagtaaacaagtatttcgaagaactggaagctaaaatgggtgccgttgctatcgagcaaggacaagctttcctcgaagaaaacaaaaaaggaccgggcgtagttgttcttcccagcggactacaatatgaaatcatcaaagaaggtacaggcaaaaagccgaaagctaccgaccaggtaagatgccactatgaaggaacattgatcgacggtacactgttcgacagctctatccaacgcggagaaccggctgtattcggtgtcaaccaagtaatcccgggatgggtggaagctttacagctaatgccggaaggttctaaatggaaactgtatattccgtcagaactcgcttatggcgcaagaggtgccggagaaatgattcctcctcacagcacactcatttttgaagtagaattactcgaagtattataaataaaaaatttcaaagcaaaatgaaaaaagttagtatttttatggcaatcgccgctgctgcaagccttgcttcttgtacagctcaagctcctaaagcaaatctgaaatcagacatcgactcactgtcttattctatcggtatggcgcagactcaaggtctgaaaggctatctgacaggtcgtctggacgttgatactgcttatatggcagacttcatcaaaggtttgaatgaaggtgcaaacaagactagcaaaaaagacatcgcttacatggcaggtctgcaaatcggtcagcaaatcagcaaccagatgatgaaaggtatcaaccaggaattgtttggcactgactctactaaaactatcagcaaagaaaacttcatggcaggtttcatcgcaggtactttggaaaaaggcggtgtaatgactatggaagcagctcaagaatatactcgtacagctatggaaactatcaaagcaaaagctttggaagaaaaatatgctgactataaagctgaaaacgaaaaattccttgctgaaaacaagactaaagacggcgtaaaaacaactgcaagcggtctgcaatacaaagtaatcactgaaggcaaaggtgaaattcctgctgacacttgcaaagtgaaagtgaactacaaaggtactttgattgacggaacagaattcgacagctcttacaaacgtaacgaaccgtctactttccgtgccaaccaagtaatcaaaggttggacagaagcattgactatgatgcctgtaggttctaaatgggaactttacatcccgcaagaacttgcttacggtgctagagaatctggcaatcaaatcaaaccgttctctactttgattttcgaagttgaactgttgggcatcgaaaaagataagaaataagaaagttcttttctaaatagaaaaaggaaagaggtgcaaaacgtttgtacctcttttttttgctttttcctattttttttctccgaaaagaagaataattaaaataaatctctatatttgcttactatttgataacaacaggaaattacaatttattattatggaaagaatagacaacctcgacaggcagatcctagagattatctcccagaatgcccgcatcccttttaaagacgtagcagccgaatgtggagtgtcacgcgcagctatccatcagcgtgtgcaaagactgattgacctaggtgtcattgtaggctctggttaccatgtgaacccgaaatcattgggatacagaacttgtacctacgtgggtatcaaactggaaaaaggctccatgtacaaatctgtcgtagcggaactacaaaagattcccgaaattgtggaatgtcatttcactacaggtccgtacacaatgctgacaaagctttatgcatgcgacaacgaacatctgatggatttgctgaataacaaaatgcaagaaataccgggtgtggtagctaccgagacattgatttctctggaacagagtatcaagaaagaaatccccatccgcgttgaaaaataattgtgatggaatttctaaatgaatatcaccttgcggggttattcatcggaatatgtacctttttgattatcggcctttttcaccccgtcgtggtaaaggccgaatactattggggtacaaaatgctggtggatatttctggtactcggcatagccggtgtggtcgcctcattaagcatcgataatgtgattttatcttctttgcttggcgtgtttgcattttcttccttctggacgattaaagaggtcttcgaacaggaagaacgggtacaaaaaggatggttccccaagaacccgaagcgcaaatataagttctaaaaataaagtatcgtagttttttatcaaaaggatttgcataattcgagggaaaatactacttttgtcaccgcatccaacaaaggatacatcggacttgtagctcagttggttagagcaacagactcataatctggaggtccctggttcaagcccaggctggtccactgaaaaattcctgtaagtgcttcacttgcaggaatttttcctttttatagccatcctccaactagaataaaagataactaattgttcccaaacaggtaaaaacaacagcaacggacaaagcagaaatggcgaagaataagcaataggggaataacacctataatattaagctatagagtacccaatattaaataattccaaaatgtttcagcgctttacaaagcccgtcattctccaccgtatcagtaacaaaattggctgaagccttgactatctccgatgcatttcccatagccactccgattccggcaactttcaacataggaatatcattaccaccatcgccgcaagccattatttccgtcattccgatcccataataatcagcaaataccgaaaggccggttgctttacttattcctgccacatttacgtcagcaaataaaggatgccagcgcgacaaggaaagattaggcagaaacgacatcactttttgttccatctcatcatcgatataaaaacaaagctgacaacactctttcttttcaaacaagttttcaatgtctacaacggtcgggatagggtgttccacgattttagcaatctgttcgacagtcggagtcagacgattaacaaacacaccttcatccaattcaatagcgactgcaaaatcaaaggtctttgctatttccatggctttcttaaaatcatctttcggaataaggtgctttcttatcacggtgccatcccgcaaaacacagtcggcaccattcaatgcaataattccgtcatacggaacatcagctatttcatgaaggtcgcctgccgctctaccggtagcaatgactattcgaattccaccgtcatgaatcttcctaagggcatcaacagaggatggcaacactttatgagtttcaaaacttaccaatgttccatccacatcgagcatgatcgcttttatcataacatttatatctttattcattcttcgacaatttagagaagcaaatcgactatccttgactgataagtcagagcagtcaattaaacagtgacaaagttactgaaaaaattcccataacaaatacaaacctccaacacataaaataaaaaaggcaaaaggaaacgagatccttttgccctatacctattgataccaactgaaaattgatagtaaacgtttagcggaagtcctttaattcttcctgcaatttctgacgggtaaagaatatgcggctctttacagtacctaacggaagattcagcttttctgcaatctcacggtacttgaatcctgaaacgtgcatagcaaacggaactctgtattctttcggcagagcattgactacacggtgcatttcttttaaatcgtaagctctttccgtactttcaaaacctgaatcttgcggcaggtttaagtgatagaggttttcagtctgatcgacaaatgtctgatcgcgcactactttgcggtaattattaataaagatgttccgcattatagtatacatccatcctttgaaatttgtgtcgggggtatatttgtcttcgttatccaatgcttttaatgaggtttcctgtaacaaatcgtttgcttcttcacgatcggttgtcagtttatatgcaaaacggagtaattcatcctgtactcctatcagatctttcctgaagcttaaacttttcatatacgttatttttaaattgtgagtattcgttatcatcattttgatgttgcaagtttacgggttttcaacaaatgtggcaggtgaagaacagacattgtttaggggaaaatctatccactgatagaatttaggtcatttttgatagtattcaggtggttttgagactgtctttatagcgaaaatcccattttgaagtcacacctgactcaaaatgggataacacaaacaaaacaaacaatattagcgattttcacaaacagctgtctttttcatctttaaaaattcataagacttaatttagaatctgttactaaaacattctaattatgggaacaaaagtattattttccggcaaaaaggaacgtagaaattaagaatagttataaataatagttgttttatgtataaaaaattgtgcctgactataaagaattgtatttaatatttgctgccaaaagaggcataaatgcttcatttgacgatattttataatatcagtattccaaagcgatgtaaattctcctacttctttttttcactaagaattaatttctatatttggagaatatacaaccaaattcagatttactatctatgactgataccatctcttaccaatatgcagctccttccgcactgcaacggtcagccgatcaggacgaactgtttcttgccaaatacagcgaaatagaaaagaaagaaacaccctgtttcttttggggaaagttgacacaaccctacatgacagcacgctgcctcatcgcattatccaatgttgtgcagtccagttttaatctgacaccgtcacagctttccatgctgaaagatccgattgtaaccgcaggaaatgaccgcctgcgttttgaaggattctctaattgtgcaggtgtatatgccagagtcgacgtgcttcctgacggacacgacggagaatttctggaaaacgggacaacaaacgtagattttaatcccggaatgatttctgccttaggaggaataggcagacaggagaatatggtaatgtcggtcggtcccaaagaggtgggactttatcataaaggtgagaaagtgatagaacgaaaagtacctcttcccgtgaaatggataaaagggctgactacggtacagatttatcaatccgttgcggaacagctctactctttcaatcgcatacaaaccttacaactcttccagactcttccgaaaagtagtgtgaaatgcgactattatttagtgatgcgcggtcaaaaacccgccttttcaccggtgaaaagcatgaatgccgtctgcattggaggacttcatcgcttacgtctgctcgagcccttgcttccatttgccgatgagctgaaagtctttgcgcatcccaccatgcaatctaccatttggcaactttatttcggtccggtacgcttcagcctttctctttcccgcgaatgttggagaggattttccggagaaggcgccgcactggaatctctgctcgaagatgtccccgaaagatggatagaagcaatggataaatacagttatgccaaccaacagttcaaccccactctttttgccatagaggaacatattgacctggagaaggtagattccctcgcggcacggctggcagccatggggttattaggattcgatttggatgaaaacagcttcttctaccgtcgcctgcctttcaaaaccgaacgtattttaagtctcaatcctcgaatgatagctgcagaaaaattactggaagaagaaaaagtagaaatcatatcgaatgacgagaaacggacagaagcacgcgtggcaggaagcggaggtgtcagacatacggtcattctcgacagagaaagcgagaaggagcgttgcacttgcacctggttcagcagcaatcaaggagaacggggagcttgcaaacatattctggcagtaaagaaactagtacaatggaagaactaaaaaaagaactcgagaaattatccaaggcttatgtggatattccggagaatgaagagaagatattaatcccttttgtcaagagattactggagttaccaatgaaagaaagacggaagctgctgccggttatccgggatttacaatggataaaaagtaagtttgccggtttcagtagtgagacaacctgcagtgcggcacgggcacattttctatctgctgtccagtttgtctgcgccaacaaacgggagatggatatggcatatcatgtaaagtttgatatgctttgcaaactactcccgctctactaccccacctggctgactgattttatcaatgatgacaaaacttggtttaatttcgatctcaattacgaacagctgatgcagctcatggatatgggatacctcaaagaaatcgctccaagccgcattgcacatgtactcccctggattacccgtatcagaaataaagaacctaaaggaaacgatactttcaacagtgagttattactcaagcgggacatcaccctgaaagaacatatctggacgattttcgaatacgaatcgtccatcggctatcaagatgattgcgccaaagaggcttataaaaaaggagttaccgcacgggatgaaagtatcagtgccgctctctaccgcttttcgctggacggccatctggatagagaacgcctattaaaagccacactcgccaccttccaccggagtttcaaaaaagatatggcaggatggtttgccggattcttcgaaactctgcaaccaactaccggagaactgttatccttgcaagaagagatgatgcaaatattcacctcttcctataccaaaccggtgaacgtgatgttgcaacagttgaaaaatattgcatccgaagaaggattccgttatcaggaattcatcgaacgtgcaaccacccttttcttctccagccccaaaaactcgctgcttaccatttacgccctctttgaaaagatcgtcgcacaacatcccgagatgaaagagccctgctgcatcactctctgccaactcttcttgaagaaagacgaaagccttcaaaagaaagccgctaattttatatcaaaacatggagacgcctcttcatccaatctccaggaaacactgcaatcttatcaaccggagatgtttcaaagcgtgcatgcgatactctcatctttcaaaccgcagcctgcggaagatacccttgaacccgatgcaagtgtaggagaaacggtacgcatctgcagggaagacaactttattcccttccccgccaacaaagaagatttcctgttccagcttagtcgtttgttcgatatggaggaaagttgggagatagaaacaaccattgccgccatcattgccttccatccccaattggacaaagaagatctcaaccggatggaacctgttttccaacgggctgccactatcgttgccaatagctgggagccatacgaagatcttctcgctaccttcctactggaatatcaacgcttatgggcacagaaagatacctccaacacaggatttttgagaaatatgttcacccgactggaagaaaggctgaaaggaatagatgaaaacagaggagcttatgacgagcgctctttcaaacgacttgccgactggaaacccggctacagcaacgcaacctgtttcacgcccatcaaacatttatggctaaatgtgatccgtaaaataaaaggaggcaatgccttccccctactttctactcccacccataccccggcatacgtacaggctaccgaactggtacgccggcttgccgtatatcagaaagcagaaacgaaaccctgtccatgggatttccagctagctattgcccgatgtgccatggaagacaaagaagaagccatcgccaccgcccggcaactgttgcaagatgaatacctgcatctctctctgttcctgttggatgaaaacacgctacccgaaccgccctacaatcatccgactgcctgggtggccgccggactggtaaaagcaccggagacggaattcgaagcattcaaatctttcgcctgtaacacattaccgcacaactatctgacaggagactacgagtggaaagaggtaaaacccaaagagaaatcatacgaaacagacaggcgtctgctccaactcgagttctacaaatggcatacatatactgaatacaacagccaccagttatggcaggaacatctgattatcaacagtaaatataacatggatgattcccgttacatggaacctttgttatgctgctttcccaaccgcccggaaccattaatagcccaaattatcacttgctacatgactttcggcactccgcaggaagacagcaaacgcaccctcgcctgtgccttgcgcatgttgttgtctttccactgcccgctcaaagagatgagtttgctcctactaagtggttcgctgctttttgtagacaaaacagtccgttcctatgcagccgaattatgggtagaaggaatatccacaggaagaataaacaatcaccgggtaggagaaatcctggcccgcctcatccagatggaacttgctccgctaaaacgcttcaccacacaagtgtacgaaagcatgtacaaacgaagtactttccacaaccagcaactggaagcactgctcacagaatttataggcggattgccagacaaacccgttaccggactcaaacaactgctcgaactttatctggagctattgaccatcaaccacagtaaggttacagacgaacaaatcctgcaacgcctacaagaatggggcacaaacagcaacctgaaaaaagtgacgacttcactcaacaacctataacaaattcatgattatgaccatagaagaacgcctcaacgagatagtagaaaaaggacaaggcgatgccatcatcccttttctgcaaggattaacgcaggaagaacgaaaaacgcttgttccctgccttaacaaattggaagaacactacaataaattcgtgcaacttaacgagaacacatacggtacacgcggaactcccgaacagcatcgtatcatcaatcttaccgctctcgtcatctattcgctaaaagaattccgcaaacacgaatggggaatctatacggaacaactgaatgaattgatcccatggtacattccttcctggatcgacagtttcttcaaagagggtgaaagcagggaattcggcggtttctatggaatgaattacgaaactctgatggattggatagaacagggagtactcaccctaacaccctctccacaaaccatcgccggttatctggtgaactacatgaacaataccgatttcctgcaaaagcgggcaatcacactcaaagaacatatctggtatctgttccaatacgattgcggacaaaactggacggataatcgtacaagcggacagccttatttctctttcagatacttcgtagaacacggtcaactagatcgtatgcgtgtattaaaagaatctctgcttgccgtcaaccggaatctgaacaaaaacctaagtagttggtttgcaggcatgtttaccgcacttaaccccagcacagaagaacaactgacactacaaccggaaatatttgccgttctgtccgcccctcacagccgtccggtaaatatcatactcggactgctgaagaacttatgcactcacccacaattccaggttgaagagtttctaagtcagacttccgtgctttttgcttcggacgtgaaagcgattcaccaaaacacactggcaatactccataagctggcaaaagaaagaaaagaacatcgcgacactatctgttgtgcagccgcacaaggactgacgagccaggaagaatccacccaaagtaagatagtcaaacttattcagacgtatggagagacggcatctactacattaaaagagatactttccatatatacggaaaccatgttggctaatactaaaaaggagctgaaagcgtatttggagaataatgagccggaagattccgcctctttcacgtatgagccaatactccctatcatccgtgaagacaaccggatacaggaaatcacttccactgaagacctgatatttctagccagccaagtgctcgacgtgaacgagatctatcacttcgacctgttactcggagccttagtgaaatgggaccggcaacaggaagcaaaacaaatctctcaatggacccctattctccaacgtgcctacaaattgctgatgagcggaggaagttcccgaaatggtatattagaccagttaatggccaccttcctccttgactatgccaaactgctgattaaacgtttccctgaagaagcccaagagttaaacaacttacatctgaaaatggtacaaaaagacgaacttcaaaaaggcaaatgggggtatcgtaatctgcaaaaactcaccattcgtgaaaagacgaacaaaaaaataaagttccccgttcataagcaactgttatgccggacattagaccttctggaaagcaaggagaaacctttgcccctattgtccactcccactcatacaccgatgtttatcgctccggaaaccctgatagaaaggttaaaacaatatcagcaggcaaatgccgaaccggacgatatggatatgcaaacagcactttcacgagtggcactggaaagttcgtcgcaagagcttcctctgctcctccgaagtttgaaaggagaataccggcacctgctcacttttttgctgggagaaaaagatgtactcccccaaccacctttcaatcatccttcctggtggatgatggcaggattaatgaaatcaccggaaacaatctattctgaatttaaagacttctcttacaataaaagtccacgtgaatttctgactggaaactttaaatggagaacctatcagtatactgactcgtacacggattataacaagaaaacggtagaatggatttgttcaactcttactttcgatattccggaaagcgagaactctcatgtcatcaataaagacaaatataatgaaagagtcagttactattcatacgatccgcatccgttactggttgaaatgtacccacagatagaacgttttgacgacatacagaacgacttaccacgtttggcatggttaactcccaatataccggagccactattggtatggtgcatccgcagtgccatatacgccccgacgttaaatgaggtaagggaagcaggtatcacccaagctgctattgaagcgcttcatcagttaaggcatacatggcacgaagtgtcttacctgctggaagccacttgcatgctggtagccgataaaacttcccgttcctatgcagccgaaatctggatagagcgtgtaggtcaaggctccatagacagtggacgcataggcagtatcttaggttcgcatcaacataccggctggggaccgctgaaaagactcactgacctgatacagcaacaaatgataaacgtcagtccgctgcataaccgggaattagagaaactaatcgtggcaatgttgaccggacttccagaaaagcctgtcaaagacttaaagaaattactagaaatatatgcagagctgttatccatcaaccacagcaaagccgaagacgaacacgttttgcacctgcttgacgcatggaaaggagtggccaatctgaagaaagcagtagctaatatccaacggtaagagaggtagcttattggagctaaagccaaaaagaagtatctttggcacactaaatacaaaaggttgaatgattattctaaaatatagtttagctattttctgtttactgctgacaggatgctccttcttttccagccataaggaaaaggagagcactcccctcatggaatacgaacaaacgacggaggatatacaaccatgcgaagaatgttccatcatctcaccaccggaacgaagcgaaatggctctctacatggactcattaggactcgtcaatatagctgacctggatagcagtctcgttgtaaaactgatgtatacacaggctgataatttcacaggcgaagtgctttacgacaacttaacggaagcctacctgcatccggatgcggcatacgctctgatagaagcacaaaaagccttaaagaaactacacccgtcttatagtcttatcatttacgatgcggcacgtcccatgtcggtacagaaaaagatgtggaacgtagtggaaggaacgtccaaatataaatatgtctccaaccccaaccgtggaggcgggttacacaactacggactggcagtagacgtcagtatccaagactctctgggacagcccctaccgatgggaaccaaagtagaccacttaggcatggaagcacacatcacagacgagatcggattggtacataatggaaaaatgagtgaaacagagcgtcagaaccgattactgctacgaaaagtgatgaaagagaccggattccgtgcattacccagcgaatggtggcatttcaatttttgcagccgggacgtagccaaacagaagtataagttaataccataaccgacactcaacaaccccataatcagagctcgacgattcattgtaatatcctataacacaataacaccatgatgcaaatctctcctgaaacccaactttttattcgcgaacattcatcggacgatgtacgtgtgctggctttacaagctaaaaagtacccggatatagatatgccaactgccatcacccaaattgcaggaaggaaggtagcagccgaaaagattccctcatggtgggagatcgaaaagatatggtatccgaaacatctgtcgctggaacaatgctcttcagaaatcaccgcccgctacaaagcacgtcttttgcagggagattctctgaccgacctcaccggcggattcggcattgactgttcttttcttgccactggattcaaatccgccacttacgtagaacgtcaggaggaactctgcgaaatagcagcacataactttcccgtactgaatctaaaccatataaacataaaaaacgaagatggagtaacctacctgcaagcaatgtcccccgtagactgccttttcctcgaccctgcgcgccgcaatgagcacggcggaaaaacggttgccatctccgactgcgaaccaaacgtagccgaactggaagagcttttacttcaaaaggccaaccgggtaatgataaaactctcccccatgctcgatctttcattggcactgaaagaactgaaacagacacaggaagttcacattctgtccgtcaacaacgaatgcaaggaactactaattctactcggacaaacatcaccggcagaaatctccattcattgtgtgaaccttttcacaaaaggaactcaaaaagaacaacactttgtattcacccgcgaacaggaacaatgcagcgaatgcacatatacggattctttagaaacctatctttacgaaccgaatgcctcccttctgaaagccggtgctttccgaagcattgcagcagcctatcctgtccgcaaactgcatcccaatagccatctttatacttccgatactttcattgaaaacttccccggaagaatattccgtattgtcaaccagtgcagtttcaataaaaaagaagtaaaggagaatctggcagacctgaaaaaagcaaatgtaactgtccgtaacttccccgccacagtagccgaactccgcaaacgaatccatttggctgaaggaggagatacctacttatttgccagtacattaaataatgggcaaaaagttctgattcgctgtgagaaagtctgaactattttctatttttgcaaaaaagaaacacaatctaaactaatccagatgaatcaaacactcataaaagccattctattactaatcgcattcaccttgtcctgtcacactctacttttctcacagagagattttgagcgacacgagttctcttttcacgcgggctacggtgttatgttccatcaccctcctacactcacgttaagtacccatagttaccaacgtacactcgcacaaggcgtaagctgggatggacaatataatttccgccctctcaaacgttttgtctttggaggaatctactccggattttcttccaaaggaagtcatcctgaagggaaggaccatttatgggttcatttcattggtactcaaatcggaatgtgtaatgccaacaccaaacattggcaaatccgcgtaacaactggtcccggtggagtcattctacggaacaacagtgaggtgttcggcaaaacacggaaagtgaaagccttcactattggtctcctgaccaatgccaatcttacctataaactgaatcccaatctgggagtcagtctaggagtacaatatatgtatagtgaactgcttagaattagaacccactatcacggagaaagggttattgtaaaactcgatggcaataatgataccaacctcacacgaataaatttcactacgggattatcctattatttctaacattcactcaaaaaaagcactatgaagaaatatatactcattcttttttccattatcagcttttggagctgtacggaagatgaatcgattgacattacagttttaccttctgtcaccactacaggtgccaacacctttggctgtctgatggacggatggatttatgtgggaggacgatacctgaattgggggcactcgtatgtctggacgtatgattcattccactactatccggaggaggacaaactatccgtcaatgtttccgtcaaacctgacatcaacatacacttcatcattttatctccccaggaaggcaaagaagcaactctcaccgatatacggttcagaggagaagaactggaagacggaacagcttttataagccattttgacccagaattgaatattatcagtgcaaccttcggcaatggcaaacgcctgactaacggacgttttgatattcattatacaacacaacagcaataatggcggcgacagtaataactattcagatttactttcttctcccgccttattggaaggattgttacttttctgatactctttgggagtggttgtctcatttccatcccgtacagccatatagtgcggcgacataatttcaatgccggcttcattaaatttatcctgaatattctgatgcaaatccgaataaatctgtgccattttatctgcctgtttgatataagcattaatttgatagaccggataccagtcgctcaaagaagtctctaacacaaacggacgcggatcatccaccactccgggagtattcaacgcagcatcaatcagtatctgattaacctgtcgccagggaatatcataaccgatagatacttccgagtgaataatcagtccatattcacgtgccgaagtactgtagtttaccgtatgagacgacatgataaatgaattgggaacagtcacaacctcatttttaggagtccgaatacgtgtcactagaggagtcttttcaatgatatctccggtggtatcattcaatttgatccggtcacccatcttaaacggacgcatataagtgataaccaatccagcgatgatattaccaataaccgtacttgatccgagcgaaacaatcaatccgacaaataccgaaataccttggaacactccggaatcggaacccgggagataaggataaatcatcgcaatcataaatgcatagagcaggaaacgagcgatatggaaagtcggcatcgcccagtccgggtagaagccgttgattttgagccgtcctgcttccacctcacgtgccagatacaagacgagacgtaccaagtatttcacggcataccagataacgatgatagtaaacaatttgggcacatagtcgataatacccacaaagataccgcgaatcggattccatatatatcctaacagttggtatgccagtccttccgtctgggggaagatgatgaaaatcaacggtacggtaaacagtagttgcaatcccatcaatatataccgcccgatactggacaggaataccaacaggttcgcctgtttctgcgcatccagcaattcatacccctggatggataccggttttatcttcgtatctttcaggcgcaggatacgcgctttcagtttacggaacaaccaattggtcaagcggaacaggaaatactgtcccacaattaccaacacaaaatagagcacacgctttgccatccgccaaagtccgtgctccgctttcatctcatgcagtttggtaatgacgttctgctgtctttccttagctaacgaatcacgggaaactccttcccacaaagcatcctgatcggtaagagaaagcaggactttactgccgtacatcaaatcggaaacaatgtccgaatggtcgatagccacagaatcgggttgtagattaaagcgtcttcctatctcttcaatcgctgcaccggtcatttgggcacgttgctgaggagtatatccgcctcgtttggtgaaaaggtagaataaggtatcaccgtccgccactaccggtattcccttagtgaactgacgcagagagtcaatacgctgtcgctgctgtacatacttgacggagtcggcagtagccatctggagcttcatctgctccatttccatccgcatattcgcttcattgagccgggcttcttccaacgatttccgcatatccgccagatggatagagtccgaatcccgtttcaaaggaacatgtccgttcgttactgtatctccggcaaatatcttcttaaccgcctgttccaactgtgcctgcgccccgattgccagaaaagaaaggaacaacaccagtaacgaccgttttattttatttatttccataccttatatcccttgattataattaaggttaatctaacttttcataaaaaacagagcaaacatacggattgtttttgacattaccatttccaaattgattatctttgccactaaaagagaaaaagcatgaatatattattacttatcgggggattaatcctcattcttctaggagctaacggattaacagacggtgccgcctcggtagccaagcgtttccgcatccctcccatcgtgatcggacttaccatcgttgcattcggtacttctgccccggaactgacggtcagtgtatcttctgctctcaaaggaagcgcggatattgccataggcaacgtggtgggaagtaacattttcaatacattgatgattgtaggctgcacggcattattcgccccgattgtcatcacccgcaatacacttagaaaagagattccgctctgcatactttcttctattgtcttgctgatttgtgccaatgatgtatttttggataaagctccggagaatatcctgaacagagtagacagcttgttgttgctttgcttctttgtcattttcatgggctacacttttgccatcgcttccaagccggttacaatggaacaacaagcagaacatccggtcatagaagaggaaacagaaatcaaatcactgccttggtggcaatccattctttatatcatcggaggcttggccgcccttatttatggagggcagttgtttgtcgacggtgccacgggcatcgcccgcaacctgggtgtcagcgaatcaattatcggactgacactggttgcaggagggacttctcttccggaactggctacgtctatcgttgccgcattaaagaaaaatccggaaattgccattggaaatgtgattggtagtaacctcttcaatatattctttgtactgggatgcagcgcgagcatcactcctctccatcttagtggaatcaccaattttgacctgtttacattagtaggttccggtattctgctttggttattcggactgttttttgccaagagaacaattacaagaatcgaaggagcgattatgatactttgttatgtggcgtacacggtagtattaatttataatacctaaataatataacaaaacacctgatattcagcttcattccaagtaaaatttccttcttcaaacatagaaactggtacaatacgaatgtttaatgatttcttccccttagtatacctgactggaatttcaaaatcatcttccagccaacgtttataagggttactatcagctacataccataaacgttctgtaacttcttcgccatcaacaaaaacacgggctgcttgtcgagcatcgttttgatcgctcaacctacgcaaacgcactccttcattttgagaagatatgttcactctaaaattactaaaattttcaaaccggacaatttctcctacatataaaatactatcctcatttccttcaaagaaactttccaattttgttcttcgtacattacccatagctttataagagtgttgcttaatggaatgcgaagaacttaaatccaagctatcagtcttcaccagtacatttttatcttgaccataataaaatatagtacccgaatgttccaaatactgattattatattctcccgactctataccaaacttcaactctgaatagaaaggataactgtcgcctatacaaaaacgagtcattgaccatgggttatccgaaagaccgtcataccctcccattggatgcacttcgggcggagtcggaaatccccagccataacaaacataactttcagaaccgtcgctctcaacttgtggagtccgtttgccatcaatatatatacgaacatccccttcacaagaaataatatgtgagcgttcggcgtgacatgtaatatgagcagcaaccatcttccctcttccttgaatagcagctatcggactatctgttcctgccacatattttctcgtataatatggtgtattacgaaaatacccggtattaaatgtaggataaaccgaccgggaaactgctatttcagaaaatcccaaagaaacaggaacaccactacgattttcaattattatcttcgcatgcttccaatatggcattggaaaataattataaaaccaaccgtatgtgttatatcctgacagcagatagttggtatcgtgaaagcccaaagaattacctcccaaacacgccaaaggacaagaaatatcgggttgttgatgagcatcccaaaacatatgaatccatacattctgcaagtgctgctcattaatctccggaagataaaattttaaagaaccaatagctccctctcctttttcatccaataaagtaatggactcgccagcattgatcttttgttccgacttacgatgatatgccaattgatctttacacaaaagattgcttccttgtttcttccataattgtatcaaagtatcataattctccttcccggtaaaggtcttgataccattgtccgcataagtgtggtatacaacatgtccccaacctccttcacctttggttctttcataaccttccagtttcacatcggtagttacacggcatcccttgttaaacggcattggaacaaaactccgtgcaacacgtatgggccctcttccgttatcaaacggaccaatataactttcagccaaaggttttataaaaggttctttttctccgaattcagataaacgcaagctaaaacgaggtgtttcttctccatcaaaataaaaacggaagagcggatcacttgaactcatatagcgatgttgtacaaggttataaatgcatcccggaccatcaacatcaaatattacccactctccacgttggtcctgataaagactccaatcccagtcggcattctttcctcttttatcaatgctgccttcataatggaccgaaattccacgatctaacaagggcaaagatgcaatatcaaccattcgtgatataccataagatatactatcggtttgccaacccaaccgtgatacagagactatcggaccaattgccgacaatgacacaaccccgaaaactaccaaacaaactaaaaaaatactttttttcataaggtgataaatataaaataaaacattaatctatctataaaatttaattcataaaagtacggcaacttatataagcatacaaccactttattatcaaatcaatatactatttcgaccttcaaaccatctgttatcatatttatttcccggcttaatccctttttgtatatataataaggtaatatactcttgtttgaaataaatagtaagaaaagtatcagtatatgataacaaagcacttttttacatattttttttgtgcttactttgcaacgtccatcttatatgttatacctaatttattatgaaaatgaagaaagtcattttgtttatcaccttattctccatgatatcattattcagttacagtaaaaatcctgtaaaacaatggggacaactacaagtgaaaggcaatcaattatgcgatcaaaccggagaccctattgttttaagaggggttagttatggctggcacaatctatggcctagattttacaataaacaatctgtaaaatggttgaaaaaagattggaaatgcaccgttttacgtgcagcaatggggacagttattgaagacaattacattgaaaatcccgaatttgcattaaaatgcatgaataaagtgattaaagcagcgataaaaaatgacctctatataataatcgactggcatacttattatccgcaaaaagaagaagcgaaagcatttttctcgatgatggcacagaaatacggaaaatatcctcatattatttatgaaatatataacgaacccatggaagacagttgggaaagcgtgaaagaatatgcaactgatattatctctgaaatacgcaaatatgatcctgataatattattcttgtaggcagtccacactgggatcaagatttacacctggtagcagaaagtcctttaaaaggattcaataatataatgtataccctccatttctatgccgccactcataaacaagagttacgggatagagctgaagcggcatgggaaaaaggaattcccatttttgtttcagaatgtgcaggaatggagtgtactggcgatgggccattagatataccggaatggacccgttgggtagaatggatggaaagtaaaaagatcagctgggttaactggtccatttcagacaagaacgaaacttgctctatgattctcccgcgagcaagcaaaaacggaggatgggatgagtctttaataaaaccagcaggacgccaaagtcgtaagtttatccgacaatacaactcatatatttataaaaataaagaatgataaaataatatcagttttaggtaaataacgtcaattatttactttccttatttactagctttgcatcaacaataaacctacgaaattttataataaagttaattttaaatttgagaaaaatgaaaaagaatctcttttcttttccccgctcaaaagtgcggatgttaaaaggatcaaaaggagtctggctcttcttgattatgttctggatgataaatacagctgcctcagcagcaggtattgagattaaaggtactgtaacagacagcaaaggtgaacctcttccgggagttaatattgttgagttaggagttaaaaagaataatggtaccatcactgatttaaatggtaaatatactataacagtagaaagccaaaaatctgttcttcagtacacttttatcggttataaaacaacagaagtcactgtaggaaaccgtaaaacaatcaatgtttcactcaaagatgatactcaatctctggatgaagtagtagttatcggctatggtacaatgaggaaaaaagatttatccggagctgtttcttctattaaaagtgatgacttgatgcttggtaatcctaccagtatttcccaagctttacaaggcaaattagccggtgtacaagtaaaccagagtgacggtgctcccggttcaggcgtaagtatcaccatccgtggtgccaactcattttctacaaattcacaaccactttacattgtcgacggcattccgtttgaagtaggagacactccaagtagtaaagcaaatgaaggcaataactcaacaaccaatcctctttcattaatcaatcctaatgacatcgaatcaatcgatattttgaaggatgcttctgcaacagccatttacggttctcgcggagctaatggtgtcgtattaattaccactaaaagaggtcgtgccggagatgccaaagttgagttctcggccaacttcggactttccaaaatagccaaaatggtcaaaatgctggatgcttacacttatgctaattatgtaaatgaaggtgtaatcaacggagctgcttatgacaatcttccctattcatacctgccttatcgtggaaaatggaactaccgtcgcgacgaaaacgataaaatcgttcctaactccggtaaatactatgcttcaccagaagattatctcaatccgggttatcgtgaagacgaatatggcaataaagaatgggtagaaggcaccaactggatggacgagatcttacaagatgcattaacacaggaatacaatcttagtgtatcaggaggaaatgaaaagagcaactatgcattttcaggcaactatacagaccagagtggtatcatcaagaattcaggttatgaacgttttgctgttcgtgccaacattggaagccatgtgaaaccctggttaaatacgggactaaatatcaactttacccgttcgttaactaagtttgccaagtcaaattcctatgattatagtatcatccgctctgctatgctttatttaccaacattatatgtaggggacaagacagaagatgattcttatgcatggttatcagccaatccacgtacatacgttaatacagctaaagatgaactgaaatcaattaatgtgtttacttctgcatttgccgaaattacaatccttgattgtttgaaattccgtcagaatctaggtatcagttattctgtaaacgatcgtgcaagttactacaatcgtgaaacaggagaaggtaaagcttccaacggacgagctggtaaaagcgacaatttctggcagaacttaacagcagaatcattggttactttcgataagacattcaacaaactacatcatctcaatgtagtagccggtttcacttacgaaaaatcagactggggtggcaaaacaatgaatgcgtccaacttcccgactgacatcacacaggacttcgatatgagccaggcgttaaatattgagacaccagccagctatcgaggacaagcagttctagtctccttattaggacgcgccaactatacactcaaggatcgctatattttcacagcatcgttccgtcgtgatggttcaagccgtttcgctcccggaaataaattcgcgaacttcgcttcaggagcagtagcatggactatatctgaagaagaattcatcaaaaacctaaatatattcagtaacttaaagttgcgattcagctacggtcaaaccggtaatcaagcgatcagcagttaccagaccatcgcttcacttgcaccatccaattaccctctcgacggaacattgagcagtggatttgcaggacaaacttacaaaggtcctttgaatgacaaactcaaatgggaaacaaccgaccaatataatgtcggactcgacatgggattctggaataacaggattagtttatccgctaactattattataaaaaaactaatgacctgctacaaaatgtatctataccgaatagtaccggttatactaccatgtggacgaatttcggtcatgtaaaaaacaaaggacttgagctaaccggtaaaatcattgcattagataaaaaagactggaccttagacttcgacggtaacatctcttttaataaaaatgaaatcggaggtttaacggccgatcaatatgctaaccaattatggtatagtgccaaagaagtctttctgcaaagaaatggattacctatcggaacactcttcggctatatagaagacggcttctatgataatatagcagaagtccgtgcagatccaatatatgccaaagcatctgatgatgaggctcgcagaatgatcggtgaaatcaaatacctggacaaaaacaatgacggaaaaataacgtcagaagaccgagctatcatcggtgatactaatccagactttatttacgggctgaacgccaatttacgatggaaaaatctgactctgggattgttcttccaaggtactcatggtaatgatatttttaatggtaacttgacaaatatcggaatgagcagtattgcaaacatcactcaagatgcttatgattcccgctggacaccagagaatgcagctaacgccaaatggcctcgcgtcactactgcaatgacccgtgacatgaaactctccgaccgttatgtagaagatggttcttacttcagactaaaaacgatcaacttaaactacaatttcggttcagtcataaaaagaattagcaacttgtctgttttcggtacagtaacaaacgtattcacgattacaggttatagttggtttgatccggatgtaaacgcctttggttctgacgcttccagaagaggagttgatattttctcatatccaagcagcagaacatattcaataggttttaaattaacgttataatctcaagaaataatgaaaaagaaaaatatattcatatatctgatggcatccagcctcctattatccggagcagtaatgacatcatgcgaaagtatgatcgaagaaaagcctttcgacttcattgtccctgaagatgttgaggattctgataacggtgccgacatgtgggtaacaggagtatataacacattacacgaagccatgttcagatacggtagtttcccacgtccgctggattatgactgtgactatatttccggtgcagtatggcagttcagccaatttggaagtggtaacttccagggaggtgacggacaagccgatgtactttggaccggaatgtactctttgattaaccgagcaaatatagcggtttctgaaatcaacaagatgcaaaatgtatcagaagtatttaaaaagaatgcattaggagaatgctattttcttaaagcatgggcatatttctatctggtacgtgcttatggagctatccctatttattccgtcagtgtaaacgaatccgggcaatatactaataatccgcgcattccaattgcacaagtatacacggaaacaatcatacctttgcttaaagacgccaaagatatgatttataaaaattcggacaatggatttaaacccggaagagtctgtgctgcaactgcggcaggtttgttagccaaagtatatgcgactatcggctctgcgtccatggctaccggagaacaaataacagtaaaaaccggcgcaccgtttgtcatgcagaatgtaaacggcactatgaccaaagtatatacagaacctgttccgacaacattctccaaggatcaagttgccggttacgaaagcttttcctctcaagaatattatagactggcctacgaaattgcaggagatataataggaggagaatatggaatacacaaacttgaggactatgatttggtttggtctccttccggcaagacttgtagcgaacatttattcagcttacaaactaagtccggtgatgaattatacggtacattattcagctcgcactactgtggcagactcaatgcagcaggaaatatagacaatagcttaacggtaggatgtagaaaacactggtatctattatttgaagaaaaagactaccgcgtggacaagggagtgttgcattgttggatacgtcagaactctgatacaagttgggggggtggttcatactatccgaactttgggaaatggcaacgtatggttgaagccaaagaacctccgttcgataatcctaaagtaacctccggatggagatgtgatgaaggaggatcagaacagttcttcgctttcacgaccaaatattcacaacaaatagccgatcagactcaacctcgtacagatgccaattacccatttttacgttatgctgatattgttctaatttttgcagaagcagctaatgaattaaatggcccgacaaaagaatcggtagatgctttaaatgatgttcgcacccgtagtaatgcaacaggcaaagaactggcaaactttacagataaaaccagcctgcgttctgcaatccttgaagaacgtgcaatggaattagccttggaaggcgatcgtcgttgggatttaatacgttggggaatttatttgcaggcaatgaatgctctaggcggaatggatgaagctaacaacgtaaaacaacgttccagcaaacatctgctattcccgattccgactcttgaaatcctgacaaaccaaggaattaatgagaataatcctggctgggattaatcacttataaccatgtaaaaaacagattatgaagaaaataaaatattttgcaataatcgcagcatccatatttactttaacatcctgtacggatattgttgaagtcgacgatctgaaagccaaagaaaacaaaccgtcaacaggtgctccgactgtagacaaagtcgttttggcaacagatgctgaatttcccattgagggagcaaatttcgaacaagtagtacgaatcgagggaacaaaccttggagatatcacttccctaaaattcaatgatatcgaggtggacagtaaggagatatattcgacatacgatatgcttctcgcacctattccccgtgcacttcctaaagaagtgacaaacacaatttatattacaaccaaacacggagaactaagtattccttttgtcgtttccatccctgatttaacaatcaatggactcaagaatgaatttacccagccgggagatacgacggttattacaggtgataattttgacctctacggtattacaattgaggaagcaattgttaatctaggcaatttaccagtaaatgtaatcgatgctactcgtacagagctgacaatagaaattcctgcaaatgccgctccgaaatctactcttactataaaaggggcaaacatggatgaagcatacaagctcacatacatggatccgggagtatctcaacttttcgatttcaataattggccgggaagcggtgcctttacacattccagccaattccctgatgccccgaaagatttcttatgtgacggcacattagaaggacaaccggaaccattagtagaaggaggaaaatatattcgcttcaataattccgtgaaagcttggggatggatggttatgtgggccggatatattactgtaccggcagaagtagccgcagacccttcatcttacgatttaagatttgaaatctgtactggagctaaatttccgatatcagcccaggcgcgtatcattttaggagattatggatggtatccttccaaaggaggaattcctgttaatacttatggtggatggcaaactgtacggatcagtgccgatacagaagcattgttgcctaatcctatcgatcctagtaccaacacagctttcaaaatcatattttctcccgaatctgctcaagattttgatttaagtatgtgtaatttcaggtttgttcataagtaaaaataaaaagggaacgctcgtactaaagcgttccctcataaacaaaaacaattcgatttatgctaaaagacttattttcattattaacgattatagcacttctattttcatcttgttccaaatcagacgaagaagaaaatggtgatgaacctcaaccaaccaaacaaacagcttatttcggagttaacctgtcaggagctgaatttgggaatgtatatccgggggtagatggtactcactatggttatcccacagaaaaagacttggattactttaaagccaaaggtctttatctggtacgttttccatttcgttgggaacgcatacaacccacaatgaatggagaattaaatgcaacagaactggcaaaaatgaagaaattcgtcaaagctgccgaagatagaaacatacagatactattggatatgcataactttggaagatattgtgtatattgcgacgggcaaagttcacaaaataatcaatatgcaatcattggtaatgcacgatgcactgttgacaatttctgtgacgtatggaaaaaactggcaaaggagtttaaagactataaaaatatctggggttacgacattatgaatgaaccctacgaaatgctggcatcgacaccgtgggttaacatagcccaagcttgcattaatgccatccgcactatagatactaaaacaaccatcatagttagcggagacgaattcagttctgccagacgatggaaagaatgcagtgacaatctgaaaactcttacagatccaagtaataacctgatattccaggcacatatatatttcgattcggattcttccggaaactataataaaggatatgatgaagatggtgcaaccgttcaaacaggggtggctcgtttgaaaccttttgttgactggctgaaagagaataataaacgtggattcgtcggtgaatatggaatacctgatactgacggtcgttggctggatattcttgatgcagcacttaaatatctacaagaaaatggaataaacggaacttattggtctgccggtccacgatggggtgactatcccttatctgtccaaccgaccaataattacacacaggatcgtccgcaattaagcacgctcctgaaatataaaagtacacaacaataatcagaataaatactgtccatgagaactcgaatcatcaccattatcactttactgctatctactccaatgattattgcacaaaaatcaatggatgagatagacagggaaagctttgcagcaaagctatctccaatagaagtaaaaggtatacagatgactgaagcaggaaatattcctcttgtcagggatactcctgcgaaaatctctttggacggaacttggcaactggcagaaggaggaagtgaaaaagaacgtttacataccatctggacagatcaaatacccgcccgtgtgcctggtagtattcacaccgcattagtagaaaatgaaatcatacctgatccatacatcggacagaatgactctattgcagaaaaacaatcttacaaaacatggtggatgaagcgggagttcgaactagactccccctcatcgcactgtatattatcttttggcggaatcgctaacaaatgtacaatatggctcaatggaaaacttttgggaacacacgaaggtatgttcggaggccccgatttttcaataggtaaatatttaaagaataaaaatactctcatagtaaaactagaagccattccccaaatgtttctgggaaactggcctcccaacgcaaatgaaagttggaaatatactgttgtattcaattgcgtttatggatggcattatgcacaaatcccatcattaggaatctggcgtagcgttcaattaaaagaacaagccgcagtagaaatagaatcgccattcatcgccactcgttcgctcaatggtcaaatgcgcttaactctcgatttgcataaagaatcatctccattaaaaggagtattatatgcagaagtatctcctaaaaactttaaaggagtaaaacaatattatcatttcgacataaatagtcagaagaaacaggaaactctatctttagaccttcaaatcaaagatccgcatctttggtggcccaatgacagaggagaacaatcactatacgacctcaacctattcttcattccacaaaaagggaagacagcccatacaaaaacgtcgttcggtatacggactattgaaatgagaccattaattgatggtgctaaagaagattattataactggacattcgtcatcaatggcaagccgatgttcataaaaggaacaggctggtgcactatggatgcattaatggacttctcaagaaataaatacgagcatttgctccagatagcccaaagccagcacatacaaatgttaagagcctggggaggaggaatgcccgaaaccgatgatttttacgaattatgcgataaatatggtattttagtcatgcaagaatggccaacggcctggaatagccataacacgcaaccgtacactatcctgcaagaaacagtggaaagaaataccaaacgattaagaaatcacccttctcttattatgtggggagcagggaatgaatcagataaaccattcggacctgcaattgacatgatgggacgacttagtatagaacttgacggaacacgtcccttccatcgtggggaagcctggggaggcagcctgcacaattacaactgctggtgggacgatgctcatcttaatcacaatttgaatatgaccgctcctttttggggagaatttgggatagcatcattgcctcacatcgagacagtgcgtagatatttggacgaggaaaaagaagtgtggcctccccaaaggagcggtaatttcacgcaccacactcctatcttcggaacgatgagagaaatggagaaactcactcaatattccggttattttatgccgaaggattcgctggcttctttcatcctcgggtcacagttagcacaagtagtaggagtgcgccatacattagaacgggcacgcacattatggcctcatactaccggagcactttattataagatgaacgataactatcctggtgtatcatggtcatgtgtagactattatggtatcatcaaacccgttcactattttgtgcaaaagtcttttgccccgttagcagcagtcatgctatttgaccgcagcaaccttgccagtcaagaagtcagtcttcctgtctatctacttgatgactgccaaacattagagaaagaaccttatcaagtcaaagtgtctatatacaatgcattactagatactgttgccacccatactttcaacggtaccggcgatgataatgtcgtcaaaaaactaggagaaataaatctgaatagagaacaaaccaaatcgaccatgctattctttgttctggacataatcaaagataacaaaaacatatatcggaattattactttaccaattacgaagtacgtccgggctccatcgtatcaatgccccaaacagaaattaaaatggaacgcacaggcaatatggtgactttaacaaatacaggaaagcaccctgctatcggagtacacgtagaagtaccagaaaaaatggaccaacttatcgtttcggagaactatatatggcttaacccacaggaatcaaaaatattaaaaataaatttggaatctccagttattgtaaaaggctggaatcttcaatcaccctattaaacagaacattatgaaaaaagtttttatttcggcttttctactacttagccttcttactctaaatggatgtaaaagtaatcaacctccggtaaaagagacaggtgaaccttacggagtaaacttggcatgcgcggacttcggttcatctttccccggtgagtataataaagactatacctacccgacagatcaagacctcgaatattggcaaaagaaagggctgaaacttatccggttaccattcaaatgggaacggctacaacttgacttaaaaggaccgctaaaccagcatgacctcaataaaatgaaagaattggtcagagcagcagagaaacgcgatatggtggttattcttgacttacataattactgtcgccgcttcatgaacaacgaacataccctcattggaaacaacggattaacaatcgaagacctggcttctttctggcaagctatcgctaaagaattctccacttttaaaaacatatatggttacgggctaatgaacgaaccacatgatctggccccggaaaccaagtggttcgacatggcgcaagcgtccatcaatgccatacgagaagtcgacacaaatacgcttattatggtaggcggcaacgactggtcatcagcagagcgttggatcgagcagagtgatacactcaaattcttaaaagacccggctaataaccttgcctttgaagctcatgtatattttgacaaggatgcatccggtacgtacaaatattcatacgaagaggaagaatgttatccggagaaaggaatcgaccgggtaaaaccatttgtagaatggattaaacagaataaattccatggttttatcggagaatatggaatccccgacaatgatccccgttggaatgaaaccctcgacttattcttgggatatttacaagaaaacggaatcaatggtacatattgggctgcgggtccgtggtgggatacctatttcatggcaattacccccaaagacgggaaagacagaccgcaaatgcctatcattgagaaatatacaagtaccttaaaaaaatagaattatgttcaaacgattctccatctgctatattttactcatgttttgtataactggaacttccgcccaagaagatcggtggacaggaaacgccacgaatctatccaaaggaaacttaagggtaaattcttcaggacgttacctagaatacagtgacggaactccttttctctacataggagatacagcatgggaactcatcagccgcttaaatgacaaagagactgaactatatttggagaatcgcagagaaaaaggatttaccgtcatacaaacggtaatcctggatgaattagatgatatggatgtttcatctaacggagaacctaagttaattgacggcaatattgacaagcccgctcccggctatttcactcatgtagacaaagttatttctctggcagcagccaaaggtttatacatagctctattaccaacttggggagataaggtagacaaacaatggggaaaaggaccggagatttttacaccggaaaatgcatatagatacggcaaatggttaggagaacgctatatgaacgcatccaatctgatatggataataggaggtgatcgaagtggagacggaaaaaactttgccatttggaatgcattagcaaccggtattaaaagtgtagacaaaaaccatttgatgacctatcatcctcatggagagcactcatcctcattttggtttcacaatgcttcgtggctggattttaatatgtgtcaatccggacacgcacaacaagatttcgcaatctatcaacgtctgcttttgcccgatttaaaaaaggaaccacacaagccatgcatggacggagaaccccgatatgaaaatattccgatcaatttcaaaaaagaaaatggaagatttggagatgatgatatccgccatacactttaccaaagtatgttcagcggagcttgtggatatacatacggctgtaatgatatatggcagatgtttgataccggacgtgagcctaaatgtgacgccgacactccatggtaccaatcaatggataaacaaggagcctgggatttaattcactttcgcagattatgggagaaatttgattttactcaaggaaaaaacctacaaaccatctttggcgatgtacctttagaaaataaaaactatcccgtagcattcggcaacaaagactacttattagtatattttccacaaggtggagagagaacgatttatttgccttcaatgaaggcatccaaacggtctttaaagtggatgaatcctcgcaatggaagaatcacattctatcaaaatacaacagcagataccattcccgtatcctctcccacaaagggaaaaggaaatgactgggttttaattatagaataattaaccgagaaaaataactatagaatatgaaaagtaatagattagaagagctaacacaaaattatgaagctcttatcaaccgaaaaaatgagatatgtaacaatagcaacggtatatataaacgttactaccaccctgtattaacagcagaacatgcaccactcatctggaagtatgattttgatgaaaaacaaaacccattcatggaagaaagaattggcatcaacgctgtaatgaatacgggagccatcaagatcaatcataaatactatcttgtggcgcgtgtcgaaggagcagaccgaaaatcattctttgcagtagcagaaagtaatagtcccgtagacggatttcgtttttgggattatccgatagaaatgccggagacagacattcctgataccaatatgtacgatatgcgcctgaccgcacatgaagatggatggatttatggcattttttgtgcggaacgcaaagatacaaacgctccagccggtgatttatcttccgcagtagccgttgcaggtattgcacgaacaaaagacctgaaaacatggcaacgcttgccggatctgaaatctccgagccagcaacgtaacgtagtgcttcatccggaatttgtgaatgggaagtatgccctgtatacccgccctcaagatggttttattgacgccggcaatggaggaggtatcggatgggcactcatagatgacatctgtcatgccgaaataaaagaggaaaaaatcatcaataaacggttttatcatacgatcaaggaggtaaaaaatggagaagggccacaccccattaaaactccacaaggatggttacatttagcacatggtgtaagaggatgcgcagccggattacgctatgtattatacttatatatgacttctttagaagatccgacagaaattatagctgaacctgcaggttatttcatggcccctataggagaagaaagaatcggtgatgtatcgaatgtattattctcaaatggatggattgaagatgataacggaaaaatttatatctattatgcgtcttcggacacccgtcttcatgtagccgaatcaacagtaaaccagcttgtagattattgtctgcacacaccaaccgacggtttccgttctatagaatctgtgaagcggatcattactatggtaaaccacaataaacaatacctgaaacaataaatacatcaccatggaaaacataaaactaagagaaaaaatcgggtatggattaggagatgctgcttcttccatgttttggaagttattcacaatgtatctgctattcttctacacagacgtggtaggtatcccttcggcagtggtaggaacaatgttccttatcacacgcatttgggacactttcctcgatccgtttgtcggaatattaggcgaccggacaagctcacgctggggtaaatttcgcccctacctactatgggtagccataccattcggcatctgtggtatactgaccttctcatcttttggagataacatgactaccaaaataatatttgcctatgccacatatacccttatgatgatggtatattcattaatcaatgttccgtacgcatctctattaggagtaatgtccgccaatccacaagtacgcacagagttctcctcctaccgcatgacatttgcttttggaggaagtattctggtactattcctcattgagccactggttgatatattcagtaaaatgaagataacggaaaatatacctgacatcgctttcggctggcagatggctgcagtcgtatttgcgattatggctagtggaatgttcttattaacttttctatggacaaaagaaagagtgcagcccataaaagaagaaaaaggatcactgaaagaagatctgaaagatctgggcagaaacaaaccctggtggattcttttatgcgcaggaatcatggcattagtgttcaattctcttcgtgacggttctgctgtattctatttcaaatattatgtagacagctccgatacattctctttctcattcatgaatagtgccattactctaatcacgatctacttggtattaggacaagccgccaatatcctcggaatcatgtttgtgccatcactcaccaaaagaatcggtaaaaagaaaacttattttgtagcaatggttggcgctaccattctaagtgttttattctacttccttcctaaagattttatctggggaattctttgtttacaggtcttaataagtatctgtgcgggtattatttctcctttattatggtctatgtatgcagatatatcagactattccgaatggaaaaccggaagacgggcaaccggcctgatattctcttcttcgtccatgtctcaaaagttcggttggacaatcggaggtgctttgaccggatggctactggcctatttcggtttcaaagcaaatgtaatccaatccgactttgctcaaaccggcatttgtatgatgatgagtatcttcccggcaattgccaccatgctatcagcattcttcatttcacgttatccgttaaatgaaaaaagattatatgaaatatcaacagaactcgaagagagaagaaaaaagtaaattcatcactaaccaactaaccaatatggctcatatttcaattcggtcctatttgtatttactattgggtacaaccctattctcatgtgcacctcaagagctaaaaacgccatttgaattaaaatgtgagaatatacccgttcctgtaggagtagatactcaaactcccagactctcctggaaacttccgctgctagaggaagatagtatcaacagagttgaaatatggctatcaacagacagtactcaattatcaggcagacagtccggttattggaacaaatccatcataggagctcccataagagtctcctatgatggacaaccattagattcatatacaacgtattattggaaaataggctatcaaacctcttccaaacagaaaactacattttcccctatatcctccttcacaacaggatgtttatcatccgacaactggaaagggaaatggattactgacaaacatgacatcacataccgtccggcaccctattatagaaagagcttccaattagacaaaacaatcgagcaagccttactcactattgcatcggcaggcctgcatgagctctctgtcaacgggcaacgggcaggaaatcatttcctagaccctatgtatacacatttcaacaaacgtatactatcagtcactcatgatgttacgtcattactatctatgggtgaaaatgtaataggagtacaactggggaacggctggtataatcatcaatccacagcagtatggtttttcgacaaggcttcatggagaaaccgccctaaattcacagcacaactccatctgcgttacacagatggaacaacagaatatctgggtactgactcagcctggcaaacaactgacagcccggttattttcaacagcatctatacagccgagcattatgatgcacagaaagaattagcaggctgggactcccccggattcaacgctaccggatggtatcatgcacaagaaaccgaatcgcctacggaaacgatcaaatcacaagttatgcatccgattcgtgaaacggcccgctatacagcaactcaatgcaaaaaaataaatgacagctgctacgtctatcatttccccaaaaacattgcaggtgttaccgagctaaaagtgaaagggaaaaaaggaacaaaactgcgcctgaaacatggggaacttttagacaaaaacggtatagtaaacatggcaaatatagattatcactaccggccgacagacgacagcgatccttttcaaacagacatcgtcatacttagcggaaagcaagatagattcatgcccaaattcaactacaaaggttttcagtttgtagaagtctcatcatctgcccctattcaattatccgacgaaaatcttattgcagtagaaatgcacagtgatgttccggccatcggctactggtcttcgtcatccgatctgctaaacaaaatatggaaagccactaacagttcctatttagccaacttgttcggttacccgactgactgccctcaacgggaaaaaaatggctggacaggagacgcacatattgccatagaaacaggattatacaatttcgatggtatctctatatatgagaaatggatgaacgacttttgtgatgaacaaaaagacaacggaatcctcccatgtatcatcccaacttctgtatggggctatgattgggccaacggggtcgactggacgagtgctgtcgccattatcccttgggaaatttatcgattttacggagataccacattactccgccgcatgtacggaccaatcaaaaaatatgtctcctatatagaatccatatcaaccaatcatcttacagactggggactgggcgactgggtacctgtacgctcaaaaagcaatataaccttgacttcctctatctattattatacggacgtctgtattctagccaaagcagccagacttttcggatatgccgaagatgcctcctattataacacgctggcacaaaaaataaaagaagctatcaacaccagttttctcaataaggaaacaggaatatatgcagggggaacacagacagaacttgccatgccattatactggggaatcgttccggaagaagataaaaagaaagttgctgccagactacatgaattggtagaaaaagacgattatcatctggacgtcggtttattaggaagcaaggccctactttccgccctgtcagataacggatatgcggaaacagcttacaaagtcgcatcacaagacacctatccttcctgggggtactggatcaaacaaggtgctacaactctacatgaaaattggcggacagatgtcgttatcgacaactcatataaccatattatgttcggagaaataggagcatggctatacaaaggactgggaggaattcagatagatgaaaaacatcccggattcaagcatattttgctaaaacctttctttccggcagacatgaatgaacttaccatacgctataatactccctatggctggttaaatatcaactgggttcgtcaaactaatgactgcatccgttatacaatcgatattccggcaggcacttctgcaacatttgttccttttacaatgccagaaccccaaaaatctataactttacaagccggaaaacattcacttgaacttgattttattcaccaattaatcaatcaacgataactatgtacaaaagaatcaccttattcacattcatttgcctgctcgctttagcaggaatagcccaaaataaagacacttataccattttattatccggagcatcttttgccgaacctaacaataagtggtttgaaatgggatgtcgtgcccttcacgccatccccatcaatcgggctgtaagtgcagaatctattgctcacactgcaaataaaatgctggacggtactctctataccccggaagagttcgataacattgatgtatttgtcttgatgcaagtacatgaaaaagacgtatataacgaagcaaacttaaaagagaactacaaggattataaaactccttttgatgcttccgactatgccgtttgctatgattatgtcatcaagcgctacatatcagactgttataaccagaaattcaatccaaaatctagatattacaacactccttatgggaaacctgcttctattgtcttatgtactcattggcatgacagtcgtccgatattcaacacttcggtccgaaaactggcagaaaaatggggattcccggtagtagaattcgacagatacatcggattctccaaaaaccagaaacatccggttacaggaaaacaatatagcctaatttacactggggattcacaagagactcatggagaaatatttggatggcatccgccacatggagaacattcatttattcaacagcgcatggctgcaatctttgccgatacgcttcgtaagatattgcttcccaaagaatatattaatgaataatcaccaaatactcatcggatgaaaaaacttctatcattaacagtttgcttgttatttgtcctatcacaaataatggcacagctttccgtaccttctttcttttcagaccacatggtgctgcaacgtgagaagccaatcaatatatggggaactgccagtgccggtgagcgaattagcgtaacattaggaaatgctcaaaagagtacccgaaccgataaaaatgggaaatggtcagtcagcctgccccctatgcaagccggtggaccgtatactctaaatgtaaaaagcctcaagcagactttatcatttacagatattttaatcggtgaagtatggatttgtagcggacagtcaaatatggagtttcgtctgcgtagcgctaatcatgctaccgaagaagtcgcagctgccaattaccctcaaatccgttcattcaacgtaattcaagaaatggggcacactcctaaaaccgacttaaaaggtaaatgggaagtatgttcacccgcctccgcttctgatttttcagctgtcggctatttctttgcacgtgaattataccaaaaactcaatattcctatcggattcatcaactcctcatggggtggtacggacatcgaaacctggatgagcatggaagtgatagagcattttccgaaatatgaaaaatcattagcccgtatgcgctcttctgaattcgaagaatacatcaaacacagtgacaaagtcaaaaaggaattcgaacaagccatcataaacgaaccgggagaaaaagagaaatggtatttagaaaacacctctacagaaaactggaaggaacatattgttccgtcattatggtcaaatgaggaattatccggtatagatggagttgtatggtttacttatcagttttccataccggtcaactgtttaggacaggatgcagaattgagtctcggtactatcgatgacgatgacattacctgggttaacggacatgaagtaggacgaacggtaggatatgacctgaaacgtctatacaagatcccggcagaagtattaaaggaacagaataccatcactattaaaatatccgactatcgtggaggaggcggtctatatggtcctaaagatgaagtatacctgaaagtcaacaaccgaattttccctttgtgtgataattggaagtataaagttgcagtatcgagtgcacaatatgattatgtagaatatggtcctaacgcttttccttctttgctgttcaacgcaatgattcatccactggtaggtttggggatgaaaggggtaatctggtatcagggagaaaacaatgccgcccgcgccaacgaatacattgatttatttccggctttaattacagactggagaagtagatggaataacgaattcccattttattgggttcaattagcaaacttcatgtctccggccaagcagccctctgaaagtcattgggcaaacctgcgggatacacagtcgaagacactggccttaccacatacaggacaggccgtcattatagacatcggtgaagaaaatgacatacatccccgcaacaaacaagatgtaggtaaacgacttgctttgcatgctctccacaatgattacggatataactctattgtttgcaccggcccgatattccagtcggtaaaaagaatcggagatgcactggaggtcacctttaacgcttgtgacgagcaactagtagctcgtaataaatatggctatttatcaggattcgccattgccggcgcagatggaaaataccaatgggcacaggctaaaatcgaaaacaataaagtaatagtatggaataaggaaatacagcaaccggtctctgtacgatatgcttggggagataatcccgatgatgctaacttatacaacgcagccggtttgcctgcctcgcctttcgaaggacacatcagccaataaacggcctacaaaaacagaaaaagaataccggcaatgaatgtatgatcatcatttccggtatttttcatatttacagtccactccctaatcgtccagagactatattttctctttccggcgcgttgtaatttaaagattatcacgtatctttgcttcctcaaatcataaatacgagatatggctattacaatcaagaaagtctccacaaagagagaacttaagaaatttatccgtttcaattacagaatgtacaagggcaacccttactctgtgcctgacctctatgacgacatgctcaacaccttcaacaagaagaaaaatgcagcattcgaattctgtgaagctgattatttcctcgcatatcgggacgataaaatagtaggacgtgtagctgcaattatcaataaccaggcgaacaagaagtgggaatgtaaaaacgttcgtttcggatggatagacttcatcgacgatcccgaagtatcatccgcacttatcaaaacagtggaagaatggggaaaagaacggggtatgactcatattgccggtcctctcggatttactgatttcgatgcggaaggaatgctgatcgaaggattcgaccagcttagcaccatggccactatctacaactacccgtactatccggtacacatggaaaaactaggcttcgagaaagatgccgactgggtggaatacaaaatctacataccggatgctattcccgacaaacataagcgtatctccgaactgatccaacgaaaatacaaccttaagataaagaaatatacttccggaagaaagatagccaaagactatggacagaagattttcgaactgatgaacgaagcatatagtccactttatggttattctccgctgacacagcggcaaatcgaccaatacgtgaaaatgtatctgccgatccttgacttacggatggttacactgattactgatgccaatgatgaactagtctgtgtaggtatctctatgccatctctcgctgaagctttacagaaatcaaacggacgtctgttgccgctcggatggttctatctgttaaaggcattattcatgaaacgtcgtgccaaaatgcttgatctgctactcgttgcagtgaaaccggaatatcaaaataaaggtgttaacgctttgttattttccgatttaattccagtttatcaaaaattaggttttatctttgcggaaagcaaccccgaactggaactgaatggaaaagttcaggcacaatgggattactttgagactcaacaacataagcgccgccgtgcgttcatcaaagagataaaataaaaaaacagctatggaagagaacgaattgatacctgtagacaacaacaatgcagtagagtacactgacgacaacatccgccacttgagtgacatggaacatgtacgcacacgccccggtatgtatatcggaaggctgggcgacggtgcacatgccgaagatggaatctatgtcctcctgaaagaagtaattgacaacagtattgacgagttcaaaatgcaagccggtaagaaaatcgagattaccgttgaagaaaaccttcgtgtcagtgtacgcgactacggacgaggcatcccacagggaaaactcatcgaggctgtcagcatgctgaataccggtggtaaatacgacagcaaggcatttaagaaaagtgtcggactgaatggtgtcggtgtgaaagccgtcaacgctttaagctcccgtttcgaggtacgcagttaccgcgacggcaaagtgcgtatcgccactttctcaaaaggaaacttactgaccgatgagacaaagaataccgaagaagaaaacggaacttacatcttctttgaaccggataatacactatttctgaattactgtttcaagcccgaatttattgagacaatgctacgtaactacacgtatctcaatacggggcttgctatcatctataacggacaccgtatcttgtcgcgcaacggtctggtagaccttttgaacgacaacatgacggcaaccgggctttacccgatcatccacctgaaaggggaagacatcgaaatcgccttcacgcataccggacaatacggagaagaatattattctttcgtcaacggtcagcatactacccaaggtggtacgcatcaaagtgccttcaaagaacacattgcccgtaccatcaaagagttcttcaacaagaacatggactacaccgatatccgtaacggattggttgccgccattgccgtcaatgtggaagaaccgatcttcgaaagtcagacgaaaactaaactgggttctaccaatatggttcccggtggcgtaacggtcaataagtatgtaggcgactttatcaaacaggaagtggacaacttcctgcacaagaatgcggacatagccgaagtaattcaacaaaagatacaagaatctgaaaaggagcgtaaagccattgcaggggtaacgaaacttgcccgtgaacgtgccaagaaagccaacctgcacaaccgcaaattgcgtgactgccgcatacacctcaacgacccgaaaggcaaaggactggaggaagactcctgcatctttatcaccgagggagactctgcaagcggttccatcaccaaaagtcgtgatgtcaacacccaagctgtattcagtctccgtggtaaaccattgaactctttcggactgaccaaaaaagtggtttacgagaacgaggaattcaacctgcttcaagcagccctgaatatagaagatggtattgaaggattacgctacaacaaagtaatcgtagcaaccgatgccgatgtggacggtatgcacatccgcctgttgctgattactttcttcctgcaattcttccctgatctcatcaagaaaggacatgtatatatcctgcagacgcctttgttccgtgtacgcaacaagaaaaagacaaattactgctacagcgaggaagaacgcatcaatgctatcaatgaactaggaccgaatccagagatcacccgatttaaaggtttgggagaaatctcaccggatgagttcaaacatttcattggtaaagatatgcgtctggagcaggtgacactgcgcaaaacggatgcggtaaaagaactactcgaattctacatgggcaaaaataccatggaacgacagaactttattatagacaatctggttatagaagaagacttggcatcatgagaaaagcaatattcccgggtactttcgaccctttcaccatcggacattactcggtagtggaacgtgcacttacctttatggacgaaatcgtgataggaatcggtatcaatgagaacaagaatacctacttccccattgagaaaagagaagaaatgattcgggaactttataaagacgaacctcgcatccaggtgatgtcctatgactgtctgacaattgattttgcgcaggaagtagaggccaggttcattgtccgcggtatccgtacggtgaaggatttcgagtatgaagagaccattgcagacattaaccgcaaactggcagggattgaaaccatcctgctcttcacagaaccggaactgacttgcgtcagctctacaattgtacgcgagttattaacctataataaagatatcagccagtttattcccaaaggaatgaaaatgagtgaataacactcgttagggaataggcgatgagtcagaaaagatgatgaagaaactaacgattatactatccgtttgcttgtgggcagttgccatacaagcccagaacttcggttccgaagccatgcgaaagttacaaatggcagagtttgcaatctccaatttctatgtggacaaagtagatgaagacaagttggtagaagaagccatcatcaaaatgctggcacaacttgatccgcactctacttattcggatgcagaggaagtgaagaagatgaacgaaccacttcaaggtaacttcgagggtatcggagtgcaattccagatgatagaagacaccctgttggtggtgcaacctgtcagcaacggaccttccgagaaagtcggcatccttgccggtgaccgtatcgttgcggtcaatgacagcgccattgccggagtgaaaatgagtacggaagatattatgaagcgccttcgtggtccgaaaggttcgaaagtcaatctaacaatcgttcgtcgtggcgtgcaagaccctttattgtttacagtgaaaagagacaagatacctatccttagcctcgatgcctcctatatgattcaacctaaaacgggttatatccgcatcaaccgttttggagcaaccactgccgaagaattcaaaaaagcaatgacaagtcttcagaagcaaggtatgaaggatatgattctcgacctgcaaggaaacggaggtggttatctcaatgcagccattgaccttgctaacgaattcctgggacaaaaggagctaatcgtatataccgaaggccggactgccaaacgcagtgatttctatgccaaagggaatggagatttccgtaatggacgtcttatcattctggtggatgagtacacagcctctgccagtgaaatcgtcagtggcgcagtacaggattgggacagaggaattattgtaggacgccgctctttcggcaaaggattggtgcaacgtcctatcgacctgccggacggttccatgattcgtttgactattgcacgctattatactccatcgggtcgttccatccaaaaaccgtacgacagtactgttgattacaacaaggatttgatagaacgtttcaaccacggtgaactgatgaatgctgacagtattcatttcccggattcgctgaaagtacaaaccaagaaactcggacgtaccgtctatggtggaggtggtatcatgccggattatttcgtacctatcgacactactctttatacgaattatcaccgtaatctggtagccaaaggagccgtgattaaattcaccatgcagtttatcgaaggacaccggaaagagttggcaaacaaatacaagaagttcgaatcgtttgatgagaaattcgtagtcgatgatgacatgctcgccaatctaaaagaaatcggagagaaagaaggagtgaagttcaatgaagagcaatatcagaaatcgctccctcttatcaagacccagctcaaagcattgatagcccgtgacctttgggatatgaacgaatatttccgggtaatgaataccacgaatgagagtatacaaaaagcactggaaatattgaattcggatgaatatcagaagaaactgaaatagggtattcaataaacaatcataaaacatcgtctttcagtttggtggacatacatactcatcatagtggacatatagatacatgatggtgagtatatatatccaccactctgtatctatatgtccactaagcgttgtgtatcaacccgttaactttattattgaatatattcgaatgtcaccgtaccgcgaatatcagaagaagaggcggcaatgtatgccttgaattttccaggttctgccacccaagtacgctgtttatcatcaaagaattgcaatgcttccggtttgattgtaaacttcacctctttttcttcattcggaagaagttgtaccttccgaaaatctttcaattccttaaccggacgcaggacactacactcctcatcaccaatgtatagttggataatctctttccctgctacttttcctgtattcttaacctttacagaaacatctatactgccatcagtattcattgtttgagccgatattacaggtttactatactcaaaggtagtataactcatgccataaccaaaaggaaaaagtggctgcaccttcttcgtatcataccaacgatagccaaccagaatatcttctttatattcttgacggatgctatcgcccggataactgatttccccaaagaaatgagccggacaatcctccagtttcaccggataagagaaaggaagtttaccactgggagtcacctctccactcaacacatcagccagcgcctccccaccaacagagcctaaataccacgactggacaatagaaggaatctcctttacccaaggcatttccaccgcatttccgctgacaatcactgctaccagatttttatttaccttcaacaaggcttctatcaactcattctgcgcaaaaggaagttcgtatgataaacggtctccaccctcacagtcctgaaaatgattcttatttagtccgcctacaaaaatcaccaaatccgaattcatcgccttttccaccgcatcattacgcaaagaatccacagtaacctgcggaataacatccgcccgtccatacatcgggcgaccgcttgtgtaaccttgtgcataaaccacaccgtcaccaaatttggcctttataccgtccagtgatgaaatcactttctgaactttcaactctgaagagccaccacctaacatcaaattacgggtagcattatctcccaccactaaaatacgtttgtattttccttgaggtacaggcaataaggcaggttgtttcttaccggttccatttttcaacaggacaataccctctgttgcaatctcataagccgtacgatagtgctcttcactagtcagtgccccgaacggtttcctgcgattcatggctgtacggaaaatcagacgcaacacacgggcagccttatcattcactacttccatcggaatcttaccttcccgaaccattttcagataagacttacccaagtaataatcgtcataaccgaattccgattctgaagtcaaaccattcgtataagatcccatttcaatatccaagccatacatggcagcttcataggtatcatgcgcagctccccaatctgttatgacacaaccgtcgaaattccattctcccttcaatatatcattattcagcagtttatgatgagtagcatgagttccgcgcaccttattgtacgctcccataatagaccaagccttccctctttccacagcagccttaaaggcaggcagatatatctcatacaatgcacggtcacttagctgcacatcgatatgtccccgccataattcctgattgttcagtgcgtaatgttttacgcaggcggctactccattcttctgcactccctgaatataaggtacacaaagctccgaggctaaataagggtcttcccccatatattcaaagttacgcccgttgagcggagtacgatagatattcacacccggtcccaacaaaacatccttttcacgataacgggcttcttcaccgatagcatatccatatttcgctgctaatagcggattccagctagctgccagacaggtcagtgcaggaaaggctgtgcaactatcgttcgtccatccggcatatccccaatcattccaattaatttcggcacgtacgccgtgaggtccgtcactcatccaaagttcaggaatacccaaacggggacagccaggggagctaaacttcccttgtgcataactaagacgagttttctcctccacagtcatacggttcaacgcatcctgtaccctaacctctatcggttgtgtatcatccagatacaccggtgtttgttctttgtcttgagcaatcgccaccatacctgtctgaacagacaggaaacatatagtcaataaaaatgtcttcattattccaataatcatttacagtttacaattcctctgccgaaatctttagtacagcttgccgaagtccctctgaagtagccgtcagctttgcttttcccggttttccatcgttctgaatgacaacaaggcattttccataaaatgctttcctcttttcatccttaaagcgttccatcgataccgggtttccgttgtctacccctgcgataaagccattaccttgtactgtgaaattcactagattgtcagcatcagggcaaagatttcctttctcatccaacacctccacagtgacaaaacacaaatcttttccatcagcagtcagaatagaacgatcaggagtcagacgaatctctgcgggttttccggctgtgcagatttccttttccgccactaccttaccactctctcgtgcaatgaccttcaccgttcccggttcaaacttcacacgccaagctacatgcagattatcaaggtctttacgcttcactccttgcgactttccattcacaaacagttccacttcatcagcctgattatagtagcaccacatatcaatctcctgtcccggagtccagttccagtgcgggaaaaggtgcaacacctgcttatccgtccattccgactgatacaaatagtagacatctttcgggaaaccagccagatctacaataccaaagtacgaactacgcgcaggccatccgtaaggagtcggttccccgatataatcaaatcccgtccatacatattgcccgctgataaagtcgttgtccctgactaatttcaagctttcctcatgagtgtttccccaaggcacatgacagttttcataagatgaacaggcaaatgtggaatcggcaaaggatttgtcccaacgcttgggccagataaacatccggtcgctgggcatacggtaatatccgcgagtcatcaacgctgaattgctttcagtaatgataaacggcttgtccgggaaattagccggaacattgggaatatccttgttatgataattatagccaatcacatccagtacgccggaacggaataaatgattgccggaattcggttcattgcatccggcagtgacaggacgggtaggatcaagcccttttacaaagcttaccaattttttcgtcagcaaagagttgacactctcctctccttctttggctaacatttcagaagaatgtccgaaatttaagatcagattggcctcttccagactcaacgtatccgctttggcatcactccattgttcgaggacttcattaccgatactccacataaagacagaaggatgattacggtcacgcaaaataaagtcattcaaatcgcgctcgtgccattcattgaagtaacgggcataatcatgtgccgtttttttcttccgccacatatcaaaagcctcatccatcacgataaatcccatacggtcacaaagatcaagcagttcgggtgcgggaggattatgggaacaacgtatgccgttacaccccatttctttcagaatttgcaagtgccgttcaatggcacgtgtgttgactgccgctcccaaacagcccaggtcatgatgcatacacacaccattaatttttgtctgcctgccattcaacgtgaatcctttccgggcatccaaactaaatgtgcgaataccgacaggagtagtatacctatccatacattcttcgtttcgcatcactttggtaaccagtgtatacagataaggagtatcaatatcccacagttgaggttgctttacagtcagttgctgggtaaaaacaacttccttaccggcttccgcttccccactcgaccgggtttcagcaacttctctgccttcagcatcctgcaaggaagaacagacagtaacattttcgttcgtatcactttcattcacaagggtagtagcgagattcagtacagcctgtttttcgtcaactgacgaggttgttacatacgttccccatccacccacatgtattgggccggtcttgcttagccacacattccggtaaatgccacaacctgaataccaccgtgaattaggttgctccgcattatccacacgtacagccagcacattcggttcatcccatttcagataaggagtcaggtcatagctgaaactaatatatccataaggacgtactcccaatgaaacaccattgataaatacctccgagttcatatatactccgtcaaactcaatgcgaaatatctttcctgcatccgctttgtctacactaaaagttttgcgataccaaccgactcctcccggaagtgcccctcctcctgtaccggaaggattttcctgactgaagtctccttcaatcgcccagtcgtggggcaaatccagtacacgccagtcattgtcggcaaaaccaggttgtgccgcttgcagcccgtctcccaaatgaaaacgccagtctgcattaaagtcggatcgctcccgcggagatacaagggaagaactgctacatgctcctaataacatcagacagcctcccaatgccaggcagctccccagtataaggcagccccccagcatcaaatattttagtttaccaatcatcatcaacggattatcattcagcttacagtttcaatgtctgctcgctgccattatacttcacagtcacccctttcgcgttcaaatcaaacggttgggctttctccttattcaccgtaactaccgtgaaagtacgctccttcagcatacccgggaactccccctgacgctcaccaatcactaaagtcttggtagcctcatcatacttcatcggtatcatggcatacatcccttgttcatagttataattcacaccttcatcttcgtataacgtaaactccccatccgctccctgataaatatacaaacggatgtgctccgccggtttttcatccgtatactgaatatcatctccgaacggaatgatagcgcctgcacgcacatacaacggaatacgctcataaggagcttctattacttttctctctcctccagcctggaatttgccggaatagaaatcataccagccctctgcttgagggaaataaatttcacgactgcggtcaccatagcgataaaccggagataccataaacgaaggaccgaacataaactggtcaccaatatcattcacttcagcatccgctgtgaaatccattaccaagggacgcatgattgtataatcatcaaaccaagtcatacctgccagcgaataaatatacggcatcatattataacgtaacttagtataatatacaaccgactgataagcaggatgcccttccggcgcaatctcccatatttcacggaaagggtattgtccgtgtgcacgatataaaggaacaaacgcaccgaattgataccagcgggtattcagctcacgccattctttataatcagcattttccgtctttgtcgcgttccattgtttctgtccggccacataacgattctctacacaaaaaccgccaatatccattgtccagtaaggtattccactcatggcaaaattcaatccggcagaaatctgtgccttcatgtcctcccaacgtgtaccgatatccccactccatgtagccgtggaataacgctgtaatccggcaaatcccgaacgggttaataagaacacccgtttgttattatctactccgcgctgaccgtcataaatggcttctgcattcatcagtgcatacgcattgaaaaattccgtagaggaacccaacgctgtaggtccgcacaaagctttccgatattccaagtcggtacagtcacgtacattcggttcgctggcatccatccaccaagcatcgatacccaacggataatagtgctcatacatctgtttccagaacagtttccgtgcatcgggatcatacgcatcataaaaaccataatggtaaccgggacctacccaatctttcaaactatctttaacagactgctgatacatccacccattctcgtcgaactccttgaaatgttcggtagtaacataaaacttaggccataccgagatcatcatacgggcatgcatagcatggatggaatcaaccattgctttcgggtccggaaaacgagctttatcaaactcatgacttccccaggcattctccggccaatgattccaatccagtacgatattatccaatgggattttacgatcacggaaacctttcagtgctcccaacatttcctcctgtgtattatacttctcacgactttgccagaaacccattgcccatttcggcataacgggagactttccggtcagcgaacgataaccgctaatcacgtcgtccatattctcaccagccataaaataataatcgagctgcttggtcatttcactccaccacgactgcttcccctgttcttccggattaacaggtgtcaatgcacgcagtccgcaataagactgtccgccatcaggctgccactcgattttcaacggcacacgctttcctgcttccaaatgagctgcaaacttataactattaggattccatgcagtccgccaacgttccggcactaccggctcattgttcaaatagaccttaacatatcccgcataataaagaataaacttgaactctcccgtttgagcaggttctatctctccttcataagtgactttagcccccattaacggcagtttcttcggaagattctcaatcgttttcagattctcgaaatagatggagtcttcccggcggaccagagtttctccttttttcggcacataagtaccggttagcgccccttcctggcctgtcttatcataaagtttaaagatacgattcaactgggagtaatcattcggattaccgaaacgacagaaggaataactatccagcagtataccatagtttttattcgaaacaacaaacggaacagaaactttcgtattatactggaacagttcttcgttcttacccttataattaaattcatccgcctgatgctggcctaatccgtaaaacgcttcatcttcgggagattcaaaaacctgacagaccgtatatcctttcgttccttccacttctatcggagtaaatgtctttcctcctcccttattctcctgcaggattaactctccgtttttatccgtaaaccacacctctccggtactagccaatacagatgctttcacttcttcagtagacactgtaatcgtatcgccattctgcacgacggcaaaagatgtttgttttttctgcggaacaacaatcagactttgcggatcggcaaacttgctgtcggcagtggcagaaacgtgaattaacttatctcccatcacctgaaggcgaaccaaacggggacctcctgtttctttgtgttgtactttgactatcacactatcacctgtcttctcgtagaccttattggaacatgctcccaaaagaagtcccggcaacaggcaatagaaaatgtttttcatattcataatcatacctacctttagggttcaacaatatattttctcatatcgcaaaagtaagtactataaatgaaaagctccccttctaatgttttatagaaggggaacttttaaacagtgaccggacgatatgtttttttcagaggtatcatttgttatttcccttctttttcctggtaaacggagggtaaaacaccaaattcatccttgaaataacggctgaaatatttaggattattgaagcctacttcgaaagctacttcggacacatgaagctggctttcacgcaataattgcgccgcccgtttcaagcgaatcacgcggataaactcaataggtgtctttcctgtgatctgaagcaatttcttatacagatgcacgcggctcatacccagttcccggctaagttcctctaccgaaagttcagtacgtgacatattatcctccacatatttgattgctttctctatcaacttttcatccagtgaagtaatcacaatctcgctaggtgcaggatcaatcattccctgggtgacacgatgataacggcttagttctatcagtttacggatacgcaacacaaggatagtcatattgaacggcttcgttacatagtcgtccgctcctgtctgcaatccctccaacttcgcttcggtattctgccgcgctgtcagcaaaatcacagggatatgcgcagtacgcttgtcctgcttaatcaggcgacacagctcattgccgtccatttggggcatcattacatcactgataaccagatcgggtaattcttcctgcatcatctcccatgcttcgttaccattcacagccagtttgacacgatactgtaattccagactataacgcataaagatacggaagtcttcattatcatctaccaccagcagcaaaggggaatccttgcgtccggtctcttccctgacttcctctttcatttccctatcttcttcatccccaaccgacatgcccgtttcttccggtaactgtacttgtgtctccacatgttttaccgggaactgaataacgaaaacagaccccgtccctatattatcgaataccttcacttctccttcatgcaaagtgacaaagtcacgtaccaggctcaatccgataccatttccggtagtttcctctactcctttatgatccgcctgatagaaacggtcgaagatatgttccttgtccacatcgctaattcctattccggtatcggcaatcttgatttccagtgtatcaggagttcctgtcacatgctctatcatcaccgtcacacgtcctccttcaggagtaaacttaaaagcattggaaagcagattcatcacaatcttccctaccttgtcagcatcaaaagccatcgagaatgtatctatacccgaaaagaaagagaattgaatatgtttcttatccgccatcaacaggaaagagttgcaaacactatgcacatacgaaatgatatctccttccgacagagacaactgatgagtactcatctctcctttacggaaatcgagcagttgattgaccagatgtaacaaccgttgcgcattacgatacatcaattgcaaacgtgtactctgcaattcatcggtcgtttctttcaacattccctccaaaggagaaataatcaaggtaagcggtgtacgcaattcatggctgacgttcgtgaagaaacggaatttcatattattgatttcttcattcttcgccacctcattttctatctgctgaagatgaaacttctcacgttcacgtttcagcatccggtagcgcgccaggaaaagcacgaccaccaaaccggcagcatacaacaaataagcccaccacgacatccagaaaggaggattgactacaatacccagcgtggcttcctttatgccgacataaccgtcgctattgatcgctttcactctcaaaacatactttcctggggcaagattcgtaaaagtcacattgtgtactcctactggcagggttaaccagtcattattgaacccttccaacttatacatatattgagttttctccggcaaattatagttgtccgaagcaaaagacacactgaaaatattctgcttataatcgaactctacattttctacatcgttcaactctttttctatcaacactcttccgccatacgactgccccactttcactgcctcatcaaacaacgaaagacctgtaaacatcacattaggcagcattttattatagcgtatatgatccggagcaaaaatattgactccatacaggccaccaatcgcaatgattccattgtgtaacgttttgattgaacgctggttaaaatcacagttctgcaatccgtcctcactattgtaagccctggaatcaaaaaggtaactcccttttccatcggaagccactgttacccgaatcaccttcctgctggtcgatacccacatattacgctcctgatcttccgtaattgccgcaataaaatttcctttggcctctacaacaggaaacagatccagaaacatatgacgcctcgtatcatacacattcaatccctcacgggtagcaatccataccaatccccggctatctttatatacatgattcaccgcatcgttcgacaatttcatactatcgctctggccttgaatcttttttatttctcgagtgcgcatatccatcgtgcctactccctgactggcagttccgaaaaacaatgtattatcatctacccaacacaaagaggttacattattctccagcagagccgagttgttactggtataagtttcaaaagtaccggataacggttccaaacattgcaaaccgcctcccaaggaagcaatccagattcttcccttatcatcctccaccaatgcccagacattattactcgccaaagcgtttccggtaccttccttataagaacgtacctgggaaccattcatacaatacaatcccccattgaatgtccctacccataatttgccgtctttcgatttcaacatagacacgacgggattcggcaattgtccttcggcgtctctccagaaaggttccgcctttcctgtagagcgattccacaaaagaatcccatggtcgttcgttccgagccacagtctatcttcatccgcctgttctatgcaagttatatctccccattcatacatattgaacttaaagatgctttcactataataagatacccccttcttataagtacctacccacatgacaccatccctgtcagcatataagtcataaattgtattatgaggcaagctccgtccattgtcatcgtgggcaacaagagaagtcactttccccgtttctttctcaagcacgtctatgccgtcataatcctttccaacccaaatcctgccttctatatcctgtgccaccgcatgaataattacgtccggacgtgacgaccagataccggtcaaatctgtccgccaactttttgttccgcaatcatacgcccagattcccataagactgtatgcccagatgcaattgtctctatctacaaaaagcgaaagttctatcgtctttcctcccggaatatatttcttaatttcatcagactgccatttaatcgccaatgtggcacgatccagacagacaagcagtcccgtattataaatcaacaagattccgtcactacattccgccatttgtgtcactccatactccggcaacgaatgttccgtatacgaaaagaagagtctctttccaccctccttgtaacggtaacatccttcacctgccacactaagccacgtattcccttcccggtctacaaaaacctgttccggaactccccatgactccagatttttcataaatccggtaacatcagtgataaagtaatcccgctccttatcaaataatacatacccccgggcggtatttatccaaaaccgtccgtcaggcatttccacaatatcggtaatgtaattatccggtaaagatcccggctcattctcggcatgctggtagatcttgaaagtatatccgtcatagcggttcagtccggtagtcgtaccgaaccacatgaacccatcacgatctttataaatagtattcacagaattattagacaatccgtccgacacttccagatgcttgaacaagtatgattgtgcagacacaatccacgaagcgagaagtaaagctaacaataaaaggctctttcttatcatgtttttcagatttgtacaaaggaaataaaatattatcaaacagccaagaaaaagagcctacggattatttgacagaataaacagcaagcgcatccaacgaagaagctaatgcaaccaaagcagcgttccagttaatggctacttcattggaagcatacgaatcttccgtatctacatacgactcatccggactggcagtaggataaaaagccccgtcctgctgtcctgggttaggtcctccaacaagaaatccgggaatagggtcttctatgtcgtccgaagccgaaaggcggtgatgaggatgcttcggactcttcgttccaagccctgtcacataacagaaacccgttgcatttcgccccaatatataatccatgtttctataggcattagtcaaataaacgtctttgccagtctggagataagcgtacatcaacgatacaccctgattcatacatttctccgcaaggcatccccaaaagaaatctttagcatcattaccataaggagcgtgaaatggggtctgttcggctccttctatgactttatccgcatatttcaaaagttccgttttcaatgaatcggcaaaacgacggtcggcttcatttaactctctgcctggttgaagccatgcaaatatacctaatgcgaacgtgttgccccatcccggagctgtgtatatttggggagccttttttattgcttcttcccggtatatctcttttccggttgagaaatagagttcgctagccgcccagaaaaattcatcgtctgcatgtgtgtcaccatattctccggtagctattgccggttgatacttctgattgagcagattctgattataataggcttccggatgcttttccgcccaggcataagccttctccgctgccagtagagcacgtttggagaatcccggataatcttcttcataagaggcaaacagacgggaggactgtgccatgactgctgcaaaatctaaagcggcagtgactgatttctgcacgacataacgttgttgtttacagtccacaggtttcacaaaaccttcaaaaaagggggtggtcagtttatgatatactcctccatcttcgggatcttgcattgttaacatccaatccaagttaaattgcatttcgtccagtaagtcgggggtatggttattgctctccgggatatttatcttttgccgggagaagtaatccagaaacagctgataaatagactgcatcaaacctattgaataaccggaattcacaatatacttattataatcgccggcatcataccaacctttggaagaagagacaattgttcccgcaggacgatcgggggaagcagcgctgggatgtatcaatacatgattatccggatgcccggccattctgtgccactgccctgcatattgttcttcaatcggcattgcggtacgctgataataaaaagacttcaaagccgcgtcagccagaggagataatacactgtcttttattaggaaagtaaccgatgctccgttcaccttcagtatatattttcccggagttgttacagcactaaaatccagtgttgttcttgttttatccgaccatgctgactttgctgtatataaagatttcccgacaaacacttgttcaccggaaacagcatcccatattacaaactcttcaacttttccgctgtctactacagctattttctcttgattgggataataacccagttgattcaatcggatagcatcgtttggtatcacacttgttgaaggagtgcacgcaaccgccaacccactcaatatcccaaacagagcaatgtatcttactattttcatacagttactaaaaaagtaggagaaggtaaacggttcgttctaccctctcctatttcattcaaatcattattttctcacgatgcggaagttatcgaaataaacttcaatagtagcttgactactaccagggttcgttgcatatacgcctatatgagtagagttcctatttaaaaagtcttgatatgtagcatctgcaacaacagaagataaagatacggaacattgcatccactttccagtctctgtctttcctgtaaaagaactcactgggacatacccatttaatgcagcatcaaagttttcacacattgcgatttggaaaacaggtccggtaaatacttctttcacaaaacattcaaactgtaatttcaaatcatcaatcggtatatttcctggaatgatgcttgtatttacccattgagcgttggaataactttgtttccaccaataattggatgcactcactgttccggtaatgcctagacaagttccattagaaacataaggagctgacgagccatctgctactacaaaactgcaatcaccccaaacatgactaccgattccatcgtaattcaatatcacattttctagaggatagaatatttctgcagattctaccgttcctccaatcgcagtcacagaaatatggccggactgggtaggagcctgtggcaatacaaaactaatctcatcaaaagtgtttgaggttgtgatgtcccccactggaatgtcgaactcaccgttaatattcacacgtgatacctcaataaaattctgtccagtaatagtaaccgtgcttcctacgactggcattgtcgaactgacagcagtaacaaccggttttggaccattcttcttaaactctgtaaccgcactgctcgtatagcactctaccacaagatatccctcttcaagcagatttgccggagctgttagcgtaatttgactatatttgttatttacttcataatttgttatctcctgaacatcaacagggcgtgtcccatcctttgccggttgttcagtagaaagataaacagcctgtacctcatagaagttaccaccgatcacagtcatctggtctcccggctttataggataggttgcggaaatacgggtgatgtaaggtgcaggcgaaagcacgtgcatattgtaagctgctactccatgctctgtttctatgcgaatttcacctttcaactcaggattttgtcctgtcagttccaattcattaggaaccgttaatatgatacttgtagaagttacataattcctgttgaaactaacctcctgatcattgatatacaccttttgtgttccacccaaatgttctccgactacaacaatcattgttcccggatttacatcagtaaaagtactatcagctttagccggatctgttactcttatataatgaattaccggtatagcatcatcgtcgtcattctggcaagagacaacagccaaaaagggcaggactaacaaccctatcaagaacaatctcgtatctaaatatttatatattgatttcataaattcttctgatttattcgttaaatgtataaggaaccggtggttcgttcaataacggattctggatgacatcagattccggataaggcaagaaaatatcctctgcttcaatattgatagtaaactccggagctgtgtaatactcaggaccttcaaggaacgtagttccatccgtgtcatacttcccaaaatgcaattttccgtcctcatctttgatgatagcatccgtccggtacccccgccactgattattaaagtagttaagcatcttgtccggtaaataacggaaccaagttaccatatcataccagtttgaatattccataccgaactcaacacggcgttcgcggataatgtcatccaacgtgatggaagactttttattaatctttgcacgctcacgtacacggttgaagaagtaaagaccacgaccgtcactcaacgtagaattgttacccagacaagcttccgcatacgtcaagtagacatctgctaaacgcaaaatataagtattaagtggcgaattcatttgtttcaccttaccgtcgttatcgtcatccggccctcccggaacaccttttttaataggagaagcagtacccttataagtatagccaccatctttaatgcaaatataagagtaataagaacccttggtaaaaaaggtagcgttcctacgcaacgtatctgccaactcgtattgctgaagcatatcaatacttccattatagctactccaacaattgacaccacccgtcacctcggtcgagaatgccaaatcagacaagagggtattacattcataccactcccccaacggcacccactgcatagcgagcagggattcctgattgttattgttcttatacttgaagagatcttcgtagtttgtcatcaagtccaacccactattctcacacacatcactggcatattgacgggcaagttctaaatcaccttcatcacgcgtaccaccattgttccagcccgaacgtgccagataaacctttgccaatatcccttttgccgcccacgatgtagcccgtcctttatcactctgctccgacaaattatcgacggcgtaattcaaatcattaataataaactgaaatacatcttcttcacgattgagcggacgaacgggattgtcaaccaacttctggttatcttcaatgagaatcaccgggccccaaatgcgcaacatatagaagtatgcacatgcacgcatcaaccgggcttctgcaattgcctttgtcttggcagcttcgctcacactaccctgtgtctgcgtctctaccgcattgattacagagttcgccatcgttactaccgagtagaatccactccatgcacccgacagattttcatccaaagctgtcacttggaaagtaacaaactgcggataattccagggactgtacatatcattggcacgcccgctaccgataggaacgatggaacgttgattgtaatcaaaccatgcccgattgtaaagcggagcggtggctgcttctaacgcttcgtcagaagtataaaatgtagcgtctacatagtttccttccggtgctctatccagaaaactgtcactgcatgctgcaaacagcagggcggtagttgctattactaataatttacttttcataaatattctcattatttgtcaggttagaaactaaggttaagtccgaaagtataaatccgttgtgaaggataacgggcattatcgataccacgcgtcagcacatcataattgtaagcacccacttcaggatcatatcctttgtactttgtaaaagtgaatgcattctggatattcatatacacccgtagattgtcaatattgagcttacttatccactttttagggaaagtataacctaacgagatattcttgatacgaagatatgaaccgtcttctacaaagcggctgctcatacggttattatcgttagcattggcagcagtgatgcgctgtacttgtgccgaaccggcattcgagacatagacattggaaagcgtagtcggttgtgatggatcgatcagttccacacgggcgatattaacagcttctttcaacattccactgttgttcatcggattggtaaattctttacgtagcatattcaccactttattaccgtatacaccattgatgaaaatattcagatcaaagcctttataagaaaacgagttgttaaaaccgtaagagaacttcggttcgggattacctaaataggtacggtctttctcatcaataacgccattgtcgtcaatatcctcataaatatagtctcctacccatatctcactttcagagatattctttccttttggaatagccactttcacacgctcaccatttttatcgagaatataattaccgtaagaatcccgcttgtaaaagtcatcctccttcgtaaacatgcctatcacgttatatccgtaaaactgtcctattggctgtcccacctccgagtaggtgtaagtctcactgttgatagtaccggaaagtcctgctgtctctgtgtaaagctttgtaatctcattcctattaaatgaaatagtcagtcctgatctccacatgaaatcatttttattgatattaaccgtattcaacgtgaattccagacctttattggtcatagcacccgcatttacccacggtgaggaaataacaccgttaacataagaaggaagagatgctttcattaacagattatctgtgtttttgtaatatccgtcaataatcagttctacccggttaccaaaaagattaatgtctagtccggcattccatgcttcagtctcttcccatttcaagttttcgtttccatagttctccgcataatatccgcttccccaaatagttgccacagttctcatctttacaccataagcatagttttctgccgcttgattaccaaccaatccccaacccagacgtaacttcaaattatccaaccaagagacgttcttcaggaatttctcattcttcaacttccatgcaagagctgccgatggaaatattccccaacgattgttcggagcaaacgtagaagaaccgtcaccacgtacagtaagtgtcaacaaataacggtcatcaaatccgtagttaacacgaccgaagtaagattcgatagcagaagaacctttggaactactattctttgcggtaagtgagctacccgcgtccagttcgtgaacagagttgagaaaatagtcactccgggtgccggaaagtgattcccaattattctcctgcgcttcatgtcccgccatggcagtaatttgatgtcgaccgaaagtattagtataagttagataagtctttaatgtccagttactaccattgctggcactacgactacctaatgactcttgggtataaagaccatagtcataagacggagtatactgataattgttgttataataataattgcctgcatactcagctctgaacactaatcccttgtaaagtgtaatatcagcaaagaaatccacatagagttgtaatcccttttcgtagttctcacgcatcagcgcttctgctaccggattcgtaaagtaagtaccatacatgttttctgactgcattccccatgaaccgtcaggattcttcgccggtacttcgggcaactgctgtatcgccgtgcggatgatattaccattgtcgatcgtattgttctgctgcgtcttggcaacagaagcacgcaacccggtagagagccagttcgttatcttattatccatattgacacgggcagagaaacgttcgaagctagaaccgataccgataccatcctgactcaaataaccacccgaaagtgaataagtagttccctcatttcctccggagatattgatctgatgattgtgcatagatgcattgcggaaaatctcatcctgccagttcgtcccttctcccagtaagctgggatctttaaactcctcacggtcaccaaagcccagtacttgagcgcgtagattttgatattccgcatattcgcgcagatttaaaacatccaacttctttggtaattgctgcaagccataatatccttcgtaagaaacttttgtcttactggctttaccctgattagtggtaatcagtaccacaccattggaagctctcgaaccataaatagctgtagccgaagcatctttcagaatttccatagaaacgatgtccgaagggttaatggaagacagtacactggagttaccgtccgtattaccggaaatcgctacaccatcaatcacatacagaggttcgttaccattcaaggaattgataccacgaatactcacagagatacctccacccggggctcccgaattttgtgtaacggaaacacccgctgcacgcccctgcaaagcttggtctaaagaagtaacaacagactttttcagttcatctccggtcacggaaacaactgaacctgtcaagtcacttcgtttcatggttccatagccgacaactaccacctcatccaacgttttagtatcttctttcagaactacgttaatgacaggttttgttgcaacaacctgctgttccataaagccgatgtaggagaagaccagcgtctgtccggtagatacattcagcgtatacttaccgttcaagtctgtaatagttcctgtcgacgtacctttcacttgtacgcttaccccaatcaacggttctccgtcagtcgcggaagttactattccggacacctttaagttctgtgaaggagcagcctccaatatcgttattggcaaccaaagtaatattgccaacgcaagacagtaccaatgtacaaatgtacattttccaagaaagtgtttattcattgtaccttatttaaatggttaatattcaatttaatcctttcataatcgctgctatggatgctgcattatgcggttgtcctgtagtacggtcaaacagtttttcggtatagccggcatcccagtacaagggaacgagcttattcttcacacaggttttcactacatattcgatatagtcattacgcgatttcaaatgattctccaaagcctctccggtcaactggtctcttaatgtcggaccatattcgccgatgattacaggaacattattattgataaatacattcagcgaacttaaagtagcctctatgtccccctcctgtccggtagcagatacatctccacctgcaaacgcagctccccattgactcttgaaattctcatcgttaggcatgattgtgaaatcataaggatcatagtaatgacattccaggaaaatacgattttgaacaatatcgagcggcattgtgaaatgcgcgaccgctttcgccacatcggtattatatgcctgcacaatcagatgacggtaatgattacgtcctccggtagctctaaccgtattgacaaacacctgattgaaaccattctgtacccggtaattctcctctgtaggctgcgcaccgttagcgtcgtcattattcacctcattggttccggcaaagagcagacggtcgtcatagtctctgaatcttaaggcgatctgtttccacatcgcttccagtctttcatccagagcttctttattggcatctaccggatggttcagccagccaccttcccagtggatattgataataacatagagaccggcatcaagcgcagctttcacggcagcctccaccttatccatccatgcactcttaatcttatacgttgccgcatcttcaaactgatgagaataagctaccggtatacgcacgacatcaaagcccgctgctttgataccctcgaaaagaaccttgttcggtgtaggatttccccaacacgtttcatcgccggaaagacttccgtcatttcccacaatcaccgcctcaaatgtattccctacattcactccggctttcatcaatgccgacagttgcatggaagtcaaatcacgcatccctgtattatcaggtgcaatgtattcatcgtatgcaggtacgctatatagggactgctttacattgataataatatcaggagcgccactcgccgaaacggtgacggtagccgtcctctctttctgcgtatcattggcctctactgtgatatttacatattgttttccttcaccgatagtatgtgaacttttacaccaactttccgaagtactgatatgccattcggccggaccgtctatctgaatagtctgcctgcttccacgagcgtcaaactccagattacgatattcctgtgccacttccagacttcctcctttttcatcactgttgctacatgatataaaagaggtggtgagcaacaccagcataaatatgactcgtttaatacccaatggactaaataatccatcactaaatgactgtttttccatattcttctatactattagattaaatttaaaaccgttaaccttgcctcatcaaaacacatttgttttctacaccacaaaattatgtattcgacatgtaacttcacttctgtaatgttattcatatagggagcgttttggaaacgatggggtgaatttgttttataaaagggattcatttgttttctcccggtttccctttatacttaaagtactcaaaatcagcatacgccttcgaatctttagaagctgatgtaatgtaaagccccaatacgactccggtaaatccgcctgctgtttcagtgcttagataacgcgtgttcatcttacccagatcatgatatattccattcactttataaccaaaataatagtaattgatatccgacttcaccaccagttccacctcaccatccgtcggtagggaaacttctttggcataatgggtaatctctcccagtttatatcgcaagccaacagaacgtttccgatccttatcctgacggacaaataaatcgtagtgagaatgaaactccataaagacggaaattcccgcttcatcattcactcccgctttctgcaagactaccggagcggatgcttccatatcaaaatgttcctgccgcaaggcgacaaaggtagggcttttccaatcgcttaacgtaacgggagtcgctatcaaacgaagttttccatctttggtaaaaatataattcttcgcttcgggattctgcagatgaatccattcgggagaaagctttccttctttaaagtctattcgttccggtctgcctttcatttcctgttgaggcagagtagggacgtccatcttcaaagaaatggttccattgctattgactacaggccaggcgtccttatcccaccgcaccggagccagatacgtttcacgtcccaatgtatgatgagttcccggcataattctgtatgccagacaaaccatccaccaagaaccatcggtgccttccaccagatcagcatgccctgttccctgaatcggactggattgtcccgattcattggcatgggtcagaataggatttgccggatttccctgataaggcccgtcaatgtaacggctgcgggcaatggttactttatgtcccaattccgtaccgccctccgaaatcagcagatagtaccagccgtctttcttataaatgtgcggaccctcggcatatctgcctccagtgccgttccatattcgtttggaagaagaaagctgtttgcctgtcatggggtcaatctcacacaggttgatgtatccatccggattactgaccataaaacatttgccatcctcaaaataaagcgaaggatcgatgcctccttgctcgagccagactggttccgaccattcactacggggatcagtagtatgtaccaggaaattccccttaccggagacattagtcgtaatcatgtaaaacactccatcattgtaacgaatggtaggagcgaaaataccgcttcccgaattagcattagtcagatcaagctgggacggacgggtcagacagtttcctatctgctcccaatgcacaaggtctttactgtgaaacaaaggcactccggggaaatattgaaagctgctgttgactaaataataatcatcccctgccttgcaaacactcggatcgggatggaaaccggggattacaggattactgtaaccttgagctgatgacttgcatacggaacaaagcgaaataaaaataaggaataaagcgtttcgcatattatataatttaagagttaaacatcttttgccagccgacgatacaaaagtagatgtttttcccaaaggaaatatggtatttcgttcacacccggtctgccaaatgttttacccatacgcacagaatgtttcccttttgcgtatgatttgttttcaaccctcttcagcttagtccaagcagcgaaaatcgaaccagtcaaagtcggccggatttgtatttgcctgcccattaccggatgcatacatacctataaatacaccggtaaatccacctaccacttcattggagacatcacgcgtggaagctgttcccaatatagcagaaacgtgggctgcctttatctcaaacgtataggtcgtctcggtggcggtgatggataagatcacctctccggtagcaggaagttctttgcaggtggtatcgaccactttatccttcaaagttttacggatcatggcaacccgctgtccgttccgctccgttatcagcaggtcataatgattcttatcatccgctcttactaccagtcccgcctcttcattttccactttcggaataaagttgacttttgcagatgcagtcagattgaaagcagcctgccggcggccgataaaagaaggagaatcattcgttgtgaagttgattgctgttcctttcagacgcagcgaacccggcttctccgtcaatgaccagaacgaatgagcaggattgcggataaaagtccagtccaaccccagtgtttcctgatcgaaatcatcacgaaccggttgttccatccaaacgtgtgacggcaggttggggaagagatatgtttcctgtacgacaccatctttacccaccttaggccagccgtcggcatcccacgtcacaggtgctaggaacgtttcacgccctaaatgctggtacttgccgttcactggtcttattcccagacaaactgcccaccagcttccatctttcagttggacgaggtcggcatgacctatcgcctggaaaggatgatcgggacagttcatattcgaaaggacaggatttacaggactgggctcatacggtccccaaggggatttactccgttgtatgacttcccgatgctcgtagcccgttcctccttcggcagacatgatatagtaataatcgcctatcttatagaaatgaggtccttccggtgaagagcctcccagaccggaagctacttttctcaaaggttccacaaacgttccggtttcggggtccatcactcccaacaggaagctgccttgattatccggactcaaaaagtacatctttccgtcgataaactcaatagacggatctacataccagttccccacccataccggatcagaccagggacctgcaggattctttgccgtcacatagaatactccttgcgaaccttttcctccatagttcgtgccaatcacatagaatgtaccgtcatggtatcgtaacgtcggagcatactgtccgccggtggaggcattgcatcccatcaacggattattttccgggcgggacagggcatgaccgatcagtttccaatgaacaaggtctttactatgataaaccggcagaccgggaaaatattcaaaggtagaagtaaccaagtaaaaatcatctcccaccctgcaaatgctcgggtcgggattcattcctgtgataatggggttcctgaatgtcttttgtgcgagggagacattagccatccataatccgattaagattaataaaagtctgcaactgttcttcatcattcttatttttaaagtttgtactgatggcaaagttcaccataatccggcagaaacaaggttcgttatgtttcaaggtgcggaacgttttctttcaggatagcgtttttcgtttcaaatataaggcaataatgttacattcggaaagtctcgcaaggcatagaagagaatagaatgtattttattggggcatgatttgtattcaattgcatttcgccctttcgggtgagtgcaattcttcctacatttgtaatagaattaaagtctcactctaaaaatatcaactcatgaaaaacattaagaaaatggtattagtatcagcctttgccggtacttgtcttacgcctcatgcacagactgcctctcctgtcatcccgaccgatccggctattgaaactcatatccgggaatggcttcagaaaatgactctcgaacaaaaaatcggtcagatgtgtgaaatcacgattgatgtggtatccgatcttgaaaccagtcgtaagaaaggattctgccttagcgaggcaatgctcgacacggttatcggtaaatataaagtaggttcactgttgaatgttcctttaggggtagcacagaaaaaggagaagtgggcggaagccatcaaacagatacaggagaaatcgatgaaggagatcggtattccctgcatctatggggtagatcagattcatggaacgacttacacattggacggaacgatgtttccgcaaggcatcaacatgggagccaccttcaaccgcgagctaacgagaagaggtgccaaaatctccgcttatgaaacgaaagcaggctgcatcccctggacgttcgccccggtagtcgacttaggccgcgacccgcgctgggcacgtatgtgggagaactatggtgaagattgttatgtaaacgcagaaatgggtgtatcggccgtgaaaggttttcagggagaagacccgaaccgtatcggagaatacaatgtagctgcgtgcatgaagcattatatgggttacggtgtacctgtttccggtaaagaccgtactccatcttccatctcacgcagtgatatgcgtgaaaaacatttcgctcctttccttgccgctgtacgtcagggtgcattgagcgtaatggtaaactccggcgttgacaacggactgccttttcacgccaaccgtgagttgctgaccgaatggctgaaagaagacttgaactgggacggactgattgttacagactgggcggacattaacaatctctgtacccgggatcacatcgctgccaccaagaaagaggctgtcaagattgccatcaatgctggtatcgacatgtcgatggttccttatgaagtgagtttctgcgattatctgaaagagttggttgaagaaggagaggtatctatggagcgtatcgatgatgcagtagcccgtgtgttgcgtctgaaatatcgtctgggattatttgaccatccatattgggacattaagaagtatgacaagttcggttctaaggaatttgcagctgttgccctgcaggctgccgaggaatcggaagtgttgctaaagaatgacggaaatatcctgccgatagcgaaaggcaaaaagattctgctgaccggtccgaacgcaaactcgatgcgttgtctgaacggcggatggtcgtatagctggcagggacacgttgctgatgagtatgcgcaggcatatcataccatctacgaggctttgtgtgagaaatacggaaaagagaatattatctatgaaccgggagtgacctatgcttcttacaaaaacgataattggtgggaagaaaacaaaccggaaattgaaaaacctgtggcagcggcagcacaagcggatattatcatcacctgcatcggtgaaaactcttattgcgaaactccgggcaacctgacggatcttaccttatcagaaaaccagcgcaatctggtaaaagctctggccgctacgggcaaacctattgtcctggttctgaatcagggacgtccacgtattatcaacgatatagtgcctttagctaaagcggttgtcaacatcatgttgccaagcaattacggtggtgatgcacttgctaacttattggccggtgatgccaacttcagtggaaaaatgccgttcacctatccccgacttatcaacgctttggcaacttatgactacaagccttgcgaaaacatggggcaaatgggaggtaactacaattatgattcggtgatggatattcaatggccgttcggtttcggattaagctatacgaattataagtacagcaatttaaaagtaaataaaccgacttttaatgctgacgacgaactgatattcacggttgacgtaaccaacacgggcaaagttgccggaaaagagagtgtgttattgttctctaaggacttagtggcaagcagcacaccggacaatatccgtttacgaaacttcgaaaaggtttctctggaaccgggagaaacaaagacggttacgctgaaactgaaaggaagcgacttggcatttgtgggatatgacggtaagtggagactggaaaaaggagatttcaagattaaatgcggtgaccaatggatggatattgtatgcgatcagacaaaagtatggaatactccgaataagaatacgctccacaaataaacctctttttatatatttctatataaacatcttcatataggatcttcttctcatataaaaatacacattcctctatcacctatcattttgctgacatcagcaaaatggtattcctgacaataaatgagagataccctgcgacgaggtatctctcattgcctatatcatccatcaataagacctaaattcaattattcttattaatcaaattgattactaccttcaccatcacgtccttttcttccgtccggctttcggcaatcattaacgtaagtgctacaaacgtattgttggtcattatcgctacccacatgtgcgaattttgcacacgtgatatcacgctccaactctccttcccgatatacattatttatatgtctaccgatgacagttctatccttctggaataagtctgccatttgcgcctgcgtcagccacaccgtctcattctccaactttacatcaatggaagttttcccatcctttgtctgataaatgacaatatttcctctattgtccataaaagacctccttgtttatgcattgcgtccgtccattaccttcgtagtaatggacggacacacaaatgtacaactttcaaaaagaaataaaaatacaaagccgtttttaattatttgctctgaagcgttataatagaacgtgccggaatctgaacaatctttccacttttcactgtccccaccggaagcaaatcttccccttctttatctgaagtacgataaatctgccattgtgcatttcctacttttcttttatgaatagaaaactctttttcttcattggcataattaatcactaccatcacatacgttccgtctacattcttataagcagaacacatcaatccctgctgatcggtgtcgccatcaggaatcaaagcgtctgtttgatcgaaagccgaaacggacaaccggactgcccccggacgaataaaacgactataattacctaaagcccacatcagtttggagtcttccactctgccatccaggaagttatcatccgtagtatattcgcgaatcaatccatccttataatcaccaccaatagcacgccaccattgccagctttcagctttggcatacacaatatcgtgatgaatgatacgtgccacatagagtgctgttttcatcgtatggtcgaaaccatttccaccaccaatttcttcatcattgcccatgatgcaggtttctgtttgccagaaaccaacttgatgtttatctaatgtatcccgtagctggcagcggatattacgtaattcacttaacggagtcgttgtccaataactatgaccgagcatcaggcggggaacattcggagtatctcccaaatacgtatccacactatccggacagaagaaagcctgaatctgatacccccgttgccaatccgtttcgtgagtgcggaacatacaacgataatcggaagactcattgaccataatctgtgtatccatgttccggtctacaaactctttgctcaatagacgaacggtgcgggctatttccctgttcgttgccggacagccttcctgcttcggaccgacccagttccagtgtccgtccggctcattgaaaggacagatatagttgaacttgatgccatcgtgttgttctactccctgcactacatcagccagaaaacgagcgtacttttcataacaatccggtttcaggttcgccgtacctccacggccggtgttggtagccaatccgttctgtgtgtaatatacgggaggagagttcaggaaagccagaaatttgctgactccccgttctttagccagtttcagaaagttgcgttgaccttgttgcttgttccagtcgtatgttccgtcgggattcaggaaacattcggcacgcatccagggggaagcaatttgactgtcctctccttgctccgtgctacctgctccgacattgaaacgccagagtgacagtccgatacctttcggttgtccgttggcgtcattctccgtgctgaacagccagtcggctatttggttttgtttctcctgcggccaaagcccgatgaattgcatactccaggcatcggaagcactaaagtatgccatcgtctgacagggttggtctgtttctatctgataacgtatattgggggcaggttgggaacatccacctgccgcaccggctattgagaagaagcctaaagcggctaaaatctttttacctttcatcctattcatctaaaatctttaattattcaaatcacacaatacggttctaaaaacatacaaacaatctattgaaatccgaaaagatataactaacgggtgggtattacttgtttaatgctcccatcttcattaaattccatgcgatctatgcatacttcacgatgaacaccgggatcactcttcagataattcttattaatgcgatgataaacaatataccacttatcagtaccgggaacttgcaagatggaattatgagcagggccatatatttccttttccgggttttggatcaatacgacagggttcttagctactttaatcggtcccaaaggtgatgtcgaagtgccataagctacatgataattaggagagccggtatcgtctaccgaccacatgaaatagtaaagcccgttacgataaaacacataagcagcctcacggtaagcataatcctgtagcgttcctccttcgggagtcatcaccgtgatagtctctttcttaattgaaatcatatcatcattaagctctgcacctgccatataaccgtttccccaatacaaatatgacttccccgaagccggatcggtgaacacgtccacatcaatctgttgcccgtgtcctgtaggtgaatctgttataataggatgtcccaagtcaacaaacggtccggcaggcgaatcacttatagccactccgatctgctttcctcctcctgctttaggatttccactgtaataaaagaaatatttatattgatctcctactaacttttcctctatacatggcgcccacgcattaccatccgcccaaggtacctgatctgattttaaatccagcatcactccttcgtccttccagttcttcagatcgacagacgaaaaaacagtaaaataccaaccaccccatccaggctgaccgtctgtggtagaataaatgtagtacttctttgtcttattggaatacaaaatttcaggatcggcatgaaaacccggcaatataggattattggattgtgaaaaagcagggaacgttactgctaacatcagaccgaacgcaattagagtttgtttaatcgttactatcattattttcattcattagataaagggggaaatatcaggttgcgatacttccccctcaagtattatattcttgatactatttatttcaatgctaccttaatagactgactatagcaatattctgatgatttgtccgatttgactcccacacgggcgtaaagatacgattcgtttaccaaaccactcgggatttcaatttcagctgtgttttcttgatcgagtgaaacagtattacccaacttcaactctgcttctttctgcttctcatccgtcaggatacctgtacccagataaatacctacattttccatattggcattggcaaccactttgttaatggtgaaacgtgctgtaatcttattaccgtttttggcaaatgacacgtttctgacaaagaaatacggcgtcacaggaatatcctgcactgtgtttcctcttacggtaatatagatcgtatcattagaaggtctttcccaaggtgcattgcccatacgcaccaatttgtaatcaccattgaaaagggacacggaataacttccatcttgggcaatatacaccggaatagaacctttcagagcataaccatcctgaaacaaagcaaattcggaacttccgcttctaacccctactgcctcaccgtcataaatagcttttccggttaatgtggctttaggttcctcaaagttgtcgtagctgcaactgcttactgccaacaaacaacatatcataataaagaaaggtataatctttttcataatctcttattttttattggaatggatttttaacaatcgtcggattgttattaattacatcatcagcaatgaatgaataatagttggactgctggaaggttcttgccaccttgaaacgttcggatctggtctttacgaaaatgtacttgtcctgatcctgtgttcccggttttgccactgcaatacgataaggatataaaccatatacgatagctttatcattatcagtatttccgttccaggtaatatcagctattctccatcgtttcatatcaaaataacggtgatcttcgaaagccagttccacacgacgttcgttctgaatcttttctattgtcaggcttgttaagctgttggccgggaaaccggcacgctgacgcaaacggttgatgtagggtaaagctgtcggttcgtcattcaattcgaaagcagcttcggcggcattcaaatagatttcacccaaacggaaccaaggccaccagttttcagcgtagttacggagagtgtaaccggatgcctcactgataaacttacggatgtagaatccggtgttgctcacattaggactgttggtttgaggtccgtcctgcccgacaaaagttttattatcttcataaaaacttcccaatttcgagtctgtcagtaaatcataagaaccggtcttatcgttccaaactgctactcctgcctgaatatccacatcttgatttctgaacttggaacccggatagataatcgtaccatacaaacgtgcatccttattagcaaaaatatcgcttggagtgtcatatactacataatcattaccatttttataatgtaacgttcccggagttccatccagataatcgaaagcctctaccaatcctagtgacgggccgatgcaagaagagttgtcgttatcctctcttaaatgatgaactacattatcataaccgaagctatgcaccttcagaggattcttataatctttcacccaaattgcttccttattcagggtcttgtccataagcatcttgtagaagttcacccctttatctgactccttctcataaagttcatatccaccttttgtgataatctcttgcgaagctgtcaatgatttgcgatagtaatcatctgccatatcggacggaatacccacttctccaccggaagtcacaatattaggagttttcagcgcgttgtacttagcgatagaaccggcatacaacatagcgcgactttccaacgctaacgctgtgtaatagttggcacgagtctgactgcctttattacccaattgcgacttaatcgcttcacattcactatatacaaaatcatatatttcgtgttcctttgcacgcggattgcgtaaataagaaggatctccgctaaagtcatactccaaagtcgttgtaatcaatggtacaccacccatacgtcttacaagctcaaaataaacgtaggcgcggataaaacggaactctgctttgaactgaagtttctcatctgccgaaatatcggtcccatacttatcgatattctcaatagacatattgatgtcacgtatcagtccgtaatcccaccagcgtccgtagtcgtttccataacgcagttcgttacgataattctgatctaatgtaccacaatacatcgcatcgtctgtttcacacataccaccggtattgaaatcaccgtgcaactgcggaatacgattataaagattggccaactgcgatttaatcatgttcggatcattccataccaactcattagtaagaatgtttttgggttctctttcgaaccaactgtcaccacaactcgacaacatggaggtgatggcagctcccatcagaagtatttttatagatttgcttttcatgatcactttcgtttttagtatgtaatattaaatccaaggaggaatgtacgttgttgcggatataccactgcagctgcggcagtaatttcaggatcgactccaaacttacccacattgtcgaacgaacacaagttagaaacattcgcataaacacgtaccttctgtgcacggatcggtctcaacagttgagccggcaagctgtaacccacttccaagttcttgatacgcagatagcgtacattgtgcaaccaaaagtcactattcttattgttatagctgaattcacctttacggatggccggataacgtcccggtatccattcactatccggatcatacaagtcggcacgatgccaacggtcttccaacaaataaaccggagagtttccgttgccatgatatgcattggccaactcatagttctgtctccatccttgcatagcaccaccggaaaggtcgatattcaagtcaatgcccttccactgcaaaccgatattaccaccaaatgacatgataggtgcccagccttcaggataaccgataggacgctcatccataccattgatgatgccatcaccattcacatctttatagataaagtcaccaggaagcagggtgcggttattatttccatccaggtttaccggataattacgaatttcttcttccgactggaactggccgattacctgatatccccaataaatacctccccaacgaccttctgcagaattgcgatattcatcccaggagttattaaaacgtggtttgtaagtctcaatacttttgtaacgtgagaaagtaaaattaccgcttacggtataattcaaatcaccgatatggtcggtccatgtaaccataccctccgcaccgatataagcttgtttattcaagttttcattaggtaacgaatagcctacttcgctcggaagcaatacatcatagcgggcagccggcacaccagtaatatccttacggaaagcatcggctgtgatcttcaaacgattattgaacatggtcaggtcaaaaccgatattcgatgtcgtattcttagtccaggataagtttgtaataggtaatcctctttggttcaatccggtaaccagctcgccatccaatacagcattaccattattccaagtataaccactcaagtaatcgaacaactttacatctttttctgtacctgtctgaccgatagaagcacgaatctttaaatcatctacaactggtctcaacttttcaaagaatttctcttccgagattctccaaccgatagatacacccgggaagaatccccaacgattattcgctgcataaagataagagccatcatagcgagccaataattcaatcagatatttgtgagcaaaatcgtaattgatacgaccaatccatccggcacgtgcctcgtaactccattcatcaccgaaactgttaagttcatcgaactgcaatagcggcaaatagtcggtagaaggttctgttccataagtcttcttagtccaatcgtaatcggaggcttcataacccaaaacagccgaaatattgtggttcttaatctgtttggcataattcaattgtaactgcatataacgcgcaggaacgctacgatcaatttgacttctccaacgtcctacggcaggagttccattataagtatctttctctttatcgtaggtataaatctgataagcatattgataaccgtcaaaacgactgttagtataattgtacgagaaagtagcctttgcagtcaaaccaaatgagaaatcatactgcgcataagcattgatattggcattacgagtcagattatctttatagccggcaatatcacggctgaaagctgccggattgtaaccattctcatgtacattattgatatactccggattatcattagcataaggactttcaatcggttgcattttgaacatagacaaaatagccgaataatatccatcaccgccaggcaaacctacatcttcggtcttttcgtatttaccgctgatctgtgcaccgatcgtaaaacgatctgtaatctttgtatcaatattcaactgaaggttggtacgttcgtatttgaagtcgcgcatcatggcatcctgtccggtatgggctacagaaaggtagtaattggtcctttcagaaccacccgtcacgttagcgttaatgtggtactgtggcacattttttctcatcaccatatcataatagtcataactcttatatcccggttccgtaccggcttcccatttcgccagttcttcggggctatatagcttgcttggatcttcgcctctgttctgcgctgcttcagccaaccctcttacatattgtcctgcatttgccagtttcgggaaacgggtcaggttttgccagccataatatccatttacattgatacttaccttatcattctttttacctttcttggtggttaccaaaaccacaccatttgatgcacgcaaaccgtagatagcagcagaagcatccttcaagactgtgatactttcaatatcttcaatgtttagagcattaaagacatcactaccggaaacatccgatacctgcaaccagtcacgactattcatacctccataaggaataccatcaattacaaacagcggactacccatattacgaatttcgagattaattcccctacccggacgagcatccacagcacgtgtagatacacctgctattttaccggacaacgctccggcagtggtggtagaaacagaacgtgtcaacgcatcagacttgacatcactgattgctccggtcaaacttttcttggtttgtgtaccataacctaccactacaacttcatccaaagtttcggtatcttcttcaagaacaatctgaagacgtgccttttcgccaatcttcacttctttagtcttataaccaataaacgagactgccagtgttccattcttatcatctacattgattgtaaaattaccatcgatgtctgtaattgtcccattagaagttccctttacagttacattggcaccaatgatatcctctccccttacatcagctacatgtcctgtaacttgtgtttgtgcaaatgcaacagcagacagaaacagctgtatgatacatatgcataagattcttaaatacctcataaattagaatttaaagattaaacattttttgttgttttttcgaacacaaatatacgtcattgatatagactgaataaacaaaaatcatgcataagagctacacaaatcatgcaatgaacgatttacatactctaaataaaatatttattcctatttttggacttgtaattgaaacaaataagcacaagttatgaaaaaacacattgcttctattctatttttattcttgttatcaacttttcagttgatagcccagtctcattctgtaaaaagattggggatagagcaaggattatcaaataattatgtagtcagcattacacaagataaacaaggattcttatggtttgccacagaagaaggacttaataagtttgacggtacccgctttactacttactataaaaatgatttggcacagaataatcagggaattaccggcaacgagcttaaccgggtgtatgcagacaccaaacgtcctattatttggatagccactcaacgagacggactaaatgcatacaattataatgagcaaacatttaccgcttatcaacataacccggaaaatccacatagtctgattacgaatgacgtaacagacatttctccttccactcaacatgatgatggtttatggattagtacctattatagaggtatagaataccttgatatcaccagcggacaattcactcattataataaaagtacagttcccggtctaccttgcgaccagacatggacagtattggacggaggtgatggaaatttgtatatcgggcatgtcggaagcgggttcagtattttttctccaaaagacaagagcgtaaaaaacttccggaacgaagccggaaacccaatgagtttgcccggtaatgatgtgttttgtattataaaagatgcaaatggaaatatctggttaggtacaaataacggattggctctatatgatgctgctaatgaaaacttcataatgttcaaaaacaacaagaatgacaagtatgctactttatgcagccgtatattatccatccgccaactgaaagataataggctttggattgcttcagaactcaatggcattgccatattaaaccttaaacaaagtatgttcctttcgccagaggagatttctcttgaatatatacaggagggtgctgatagccgaagtctttctaatgcaagtgcccgatgcatattccaggattcttttgataatatctggatagggacatggggaggaggaatcaactttatcagcagtaaaccacctttgttcaccacattgagctattcccctattccaaacaatgagaacagtttgaacaacaaagtagccagtagcctctgtatggacagacaaggacgggtttggatcggaacagacggtggaggaatcaatgtatttgaaggagagaaacgtatcgctatctataaaaaagagagtggaaatattccttcgaattttatattagcctctttgcaggattcaaaaggtaatttatggtttggttcctaccaagggggaatcagctattatgataaccggaataaaaaattccgttccatctctcttatggggcaatctaatctggatgtccgtacgatctatgaagatacccagcacaacatttgggtaggatacagtggagggattgttatattgaaccctcttacaatggagattatccgacattacaatacagaaaacagcgaactacaaagtgactttatacgctccataactcaagatgagaaagggcgtttctggattgggactttcggagacggacttggtatatacaccccggacttacaaaaaatcaaaacgttcactcaaagggatggtttctgttccaatactgtcaaccagatcatacaagataaacaaaaaagaatgtggataggaacaggagagggattggtttgtttcctgtctaccgatgaactgaattataagacttatcaacggaaagacggcctgatcaatacaaatatctgcgctatagcagaagacaaaaaaggaaatatctggtttagtaacaacaaaggtatcagctgttatgttacaagcaaagactgtttttacaattatagtcactctgatgatgtaccggcaggaagtttctcaagcagttgtgttacacaaaacaagaacggatggatttatttcggttctatcaatggagtatgctgtttcaatcccgatatcaccatgaacgaacaaccagctccggcagcagttatcacagaaatgaaaatactcggacggttaagcaatctggaaaacaatgacatgattatcaatttatccaaaggacagaatgtagaattaagtcatgcgcaaaatagctttggacttacatttaacgtacaaaactactcactagtcaaccaagtggaatatgtttatatgctgaaagggcttgaaaactcatggtacaccgtcaatgagaacaacagcgtcactttccgaaacattcctccgggaaaatatgaattcctcatcaaagcaagggtacataatcaagaatggcctgaagaagctacttcacttaccatccgtgtcaatccccctctttggctgacatggtgggcaaaacttatctatatttgggtatctatcagcatcatttatcttatcctgcatgcatataaaaagaagctggatttggaaagcctctatacgctggaaaagaaaaaccatgagcaagaacaggaattgaaccaggaacgtttgcggttctatactaatattacccatgagctgcgtacgccattgaccttaatcctcggtcctttggaagatatgcaaaaagagacctcacttccggcaaaacaagcccagaagttatctgtcatccatcagagtgcactacggttgctcaacttgattaatcaaatactggaattccggaagacagagacacaaaacaagaaattgtgtgtcagcaaaggcaatatcgctcctctgatctatgagatagggcttaaatacaaagaactaaatcaaaagaccaagattgatttccaaattcagatagagaaagaagaaatgctccttttctttgataaggaaatcattaccatcgttttggacaacctgatttccaacgcgatcaaatatacggaacagggacgcgtcactctaagtttgtatcagacaatgcgcaatgaggttgcttatacagagataaaagtcagtgacacgggatatggaatttctgctgaagccctgccacatatttttgaccgttattatcaggaaagcggcaagcatcaggcatccggaacaggcattggcttggccctagtgaaaaatctggtcaccctgcatgaaggagaaatccgggcagaaagcatacaaaacgaaggaagtactttctatatcagcctattgacggataatatctatcccaatgctttacacgcagattctacagaaccgattcaagaagatacgaatcaggaagcaagccttgaatatccacaagaaaccacactggatatcggtaaaccgatcctgttgattgtagaagacaatgaagagatacagaaatatatcgctgagtccttcgcagattcattcgaagtactcacagcctacaacggagaagaagggaagcaacaagctcttagccgcatcccggatattgtagtcagcgatattatgatgcctgtcatggacggtatcattctctgccggcaattgaaagaggacgtacggaccagtcatatccctgtcatcctattgacagccaaagactctctgcaagataaagaagaaggatatgaggtaggagccgattcttatctgacaaagcctttcagtgcttctctgctgcgtagccgtatcaataatctgctggaatcaagaaagaaactgatagctcaattccagacacaatccgttccgggcaatcaggcagatttaaaagaaaaacgtatcgtaatcgccgaagctctaagcaagctggataatgaatttattgaaaaaatcacccttttaatcgaagaaaacctctcttcggagaagattgatattacctatctttcagacaagatgtgtatgagcggttccaccctctaccggaaaatgaaagcactgacaggattatcgaccaacgaatatatccggaaagtgaaaatgcaaaatgcagaacgtttattgcttgaagggaagttcaacatctctgaaatcgcctataaagtaggaatgaacagtacggggtatttccgtcaatgctttaaagaggaatttggcgtctcgccttcggattacctgaagcagatcatacaatcataaaaagggagagagccatttacacttaatacgttttgagaaacaaattaagctcctaccgaaaaagaagagggtaaagtcataatgcctaaattaaaaggaaagagtccggtgctaataccgaactctttatctatcttgctaatttataaacctccaacttttggaggccacttcaaacgatgcggcaggagtatttctctaaagaaaagtgttttaacacattctttataaatctaattataataaaggaggggaggaacctattaaaacagaacctgttaaacagcatctacaaaaaggatttacaagtagcagtcgtgcgaactaagtcattccctcaattcttcagtcattgtctttagtaatgacctgctatcacttaacggcaaatccgtagctaaatcccaactcatcatacctttcagcttctgttcttttgcataacgggttttgatacgaatgttatcctgaccgtcaaacacataagtatctccctgatagatcacttcattctgtgcaggactcgtaaccaatccattctgtacaaaattgaaataagcctctgtcttctttgaattatctttggtcaccccataaaaaggaactcctgccaccagtttttccttcggaataccatactccaataccatctgtatatccgaacaatatttctctatcggaaaacgaaccggtgaaggaccatagcactgaagtgaaataaaatcaacagcttcaatagcttccttactaatcttataacaaacaggatgcagagatacactgaaaagatacttgtttcccaacacttcccgcatcttcaggatagccaaactataatctttatattctttctcattttctgcccactcaaaatcaagatcaatgccatccagtttattcttttccagtacagtctttatgttctttgcaaacgtcgtacgagcggcctcatcggccaccatcgctttccattcgccactggaagctcccaaacgtattttcacttttgtaccttttacttttgcacgaaccgatttaatcaaaccttcccaagtggtcaccccttttccctgaaatgcacgtggattctcaaatgacaatgatccgtctttattaggatgaacattcaagaaaataaggtcgtcacttgcccgcaagctttctgtagagatacgaccacggttgtaaaaattaccccgcacataagaactgaccatatagtcttgctgtgcaaacaatgataatccaacaaacaaaaaaaagaagaagaatacaatttttcttagcattagcataatgattgataattaaaacgtttagattgcaaaaatacgcatatcaaagggaaacagatgttcaaaaacaactataatacttccaaaaatcaacataaagttttctattcagaaatttacaacagataaatattgaattctctaacatcatccaaagggataagaataatatttgcaggtttctactaaaacataaataaaagaaagagttccattttccgcaaaaaaagcctatctttgttccgttaagataataaatcacgcataaaactcatgccaggagattcattttgcatacaatataccaactgtacgggatgtccaaaaaatgttgagaatatccttgtatatagaaacttacctaaaggagagcatatccccaaggataagtgtacgcagaattgtatgctttttatgataaagggcgaattacttatcaatagcgaagagcatcccggaataacgttacgcgagagacaaattgttttgcaagctattggctccaaggtcgaaatactggcactgacagatgttgaatacgttgtctactggttcaacgaactgcctttgctttgcgaagaccgatatagggaaatgatggaacaggcggaagctcctttgacctacactccactgattatgagcgaaaggctttaccaccttgtcaccagtatgcccgaattcctcgctgaggaaaacccttgcagcaagtatatcgacttaaaatgcaaagaactggttttcttgattaccaacttctatccgctaccccaactgggttcattcttctatccgatcagcacttatacggaaagtttccactatttcgtcatgcagaattacagcaaggtgaagaacgtggaagaatttgcgcatctgggaggatatacgaccactactttccgccgacttttcaaaaacctctatggtgtgccggtatacgaatggatactggaaaagaaacgggaaggaatcctggaagacctacagcacaccaaaatgcgaatcactgaaatctgtaacagatacggattcgactccctgtcgcatttcgcccacttttgtaaagactctttcggagataccccacgcgctttacgcaagaaagcagccggcggtgagaaaatcgggaaagtacaataaacagcctcatcctactaatgtgccaatcagttgcaccatgcgtacatactggctggcatattgatacattagcgcattgattcattattaaagaattatttctttaattccttgctcaatcaatctatttcccctatttttgcagtctgtaagaggtgtaaaacgtcgaaattttagttctaacaattaaataatttaaattcaatcatttatgtggttaagtaattcatctgtaggaaggaaagtggtgatgagcgttaccggtatcgcccttgtcctgtttctaacatttcacatggcgatgaacttggttgcaatcatctcagctgatggttacaacatgatttgtgagttcctgggagcaaactggtatgcgttagtggctaccgcaggactagccgctctttttgtgattcacatcatctacgcattctggctgacaatgcagaatcgcaaagcgcgtggtagcgaacgctatgcagtggttgacaaaccaaaaactgtagaatgggcatctcaaaacatgttagtgctgggtctgatcgttatcgtaggtcttggtttgcacctcttcaacttctgggcaaaaatgcagttgccggaactgatgcacaacatgggcatgcacgctgatacactgacgctggcttatgccgctaacggtgcttatcacatccagcagactttctcttgcccggtttacgtagttctttacctcgtttggctgtttgctttgtggttccacctgactcacggtttctggagctctatgcaatcactgggatggaacaacaaagtatggatcaaccgttggaaatgtatttctaacatctattctacgattgttgtactcggtttcgcactggtagtagtggtattcttcgtgaaaacactgatttgtggcggtgcttgctaaatagtaaattgtaaatgattaaattgtaaataatattatgatcaagatagattcaaaaattccagaaggcccggtggctgagaaatggaccaactataaagctcaccagaaattggtgaaccccgctaataaacgtcgtttggacatcatcgttgtgggtacgggtctggcaggtgcttctgccgctgcttcacttggtgaaatgggtttcagagtattcaatttctgtattcaggattctccccgtcgtgcacactctatcgctgcacagggtggtatcaatgctgcgaagaattatcaaaatgatggtgactccgtttaccgtctgttctacgatactgtaaaaggtggcgactatcgtgcccgtgaagcaaacgtatatcgtttggctgaagtgtctaacgctatcatcgaccaatgtgtagcgcaaggtgttcctttcgctcgcgaatatggcggtacgctggacaaccgttctttcggtggcgcacaggtatcccgtactttctatgctaaaggccagactggtcagcagttgctgctgggtgcttactctgcattgagccgtcaggtaaacgtaggtactgttaaactgtacacccgctacgaaatgcaggatgttgtcatcgttgacggacgtgcccgcggtatcatcgcaaaaaatcttgtaacaggcaaattggaacgtttcgctgctcacgctgtagtaatcgctaccggtggttatggtaacgcttacttcttgtctactaacgctatgggttgtaactgtacagctgctatctcttgctaccgcaagggtgctgtattcgcaaatccggcatacgttcagattcacccgacttgtattccggtacatggcgacaagcagtctaagctgactttgatgtccgaatctctccgtaacgacggtcgtatctgggttccgaagaagaaagaagatgctgtaagactccagaaaggcgaaatcaaaggaagtgatattccggaagaagaccgcgactattacttggaacgccgctatccggcattcggtaacctggttccgcgtgacgttgccagccgtgccgctaaagaacgttgcgacgctggtttcggtgtaaacaacacaggtttggccgtattcctcgacttctctgaagctatcaaccgtttgggtatcgacgttgttcttcaacgttatggcaacctcttcgatatgtacgaagaaatcactgacgttaacccgggcgaactggccaaagaaatcagtggtgtgaaatattataacccaatgatgatttatccggctatccactatacaatgggtggtatctgggtagactacgaactgcaaaccactatcaagggtctgttcgctatcggtgaatgtaacttctccgaccatggtgcaaaccgcctcggtgcttctgcattgatgcaaggtttggctgacggttacttcgtattgccttacaccatccagaactatctggcagatcagatcactgttcctcgtttctctaccgatcttcctgaattcgctgaagctgaaaaagctgttcaggctaagattgacaagttcatgaagattcagggtaaagaatctgttgattctatccacaagaaactgggtcatatcatgtgggaatacgtaggtatgggacgtacggcagaaggcttgaagaaaggtatcgctgcactgaaagaaatccgcaaggaattcgaaactaatctgtttatccctggttctaaagaaggcatgaacgtagagcttgacaaagcaatccgtctgtacgacttcatcactatgggtgagcttgttgcttacgacgcattgaaccgtaacgaaagttgtggtggtcacttccgtgaagaatatcagactgaagaaggagaagcaaaacgtgatgacgaaaacttcttctatgtagcatgctgggaatatcaaggtgacgatgaaaaggctccggtattgcacaaagaaccgctggtatacgaagctatcaaggttcagacccgtaactacaagagctaatcggtgaagttaaacatttaaaagaattagaagaaaatggataaaaatatatcatttacactgaaggtatggcgccaagctggtccgaaagctaaaggtgcttttgaaacctaccaaatgaaagatatccccggtgatacttccttcctcgaaatgctggatattctgaacgaacagctcatcagcgaaagaaaagaaccggtagtattcgaccatgactgccgcgaaggtatctgcggtatgtgttctctttacatcaacggacatccgcacggtcctgcaacaggtgctactacttgccagatctatatgcgtcgtttcaacgacggtgacaccatcactgttgaaccttggcgttcggctggtttccctgtcatcaaagacttgatggtagaccgtactgcatacgacaagattatgcaagctggtggttatgtaagcgtacgcacaggtgctccgcaggatgctaacgctatcctgatcgcgaaacctatcgctgacgaagctatggatgctgcttcttgtatcggttgcggtgcttgtgtagctgcatgtaagaacggttctgctatgttgttcgtttctgcaaaagttagccagttgaacttgctgccgcaaggtaaaccggaagctttgcgccgtgcaaaagctatgttgtcaaagatggacgaactgggattcggtaactgtacaaacactcgtgcttgtgaagctgaatgtccgaagaatatttctatcagcaacatcgctcgcttgaaccgcgacttcatcatcgcaaaattaaaagactagaaattgctagatttcaatagcgagagcttaatttgattaatgacagaatcccctgccggctagtccgacaggggatttctttatgtatgagtagatcacaattattattaatacggatcagtaacatgaacttttaattcataagtttcaccgatttcaccttatagccaaaactgttatgaatgagagaattacgggtgaaagcgaggattgaaataaggtaaaatcattcgttaccgctttcacctgtcttattaaaatatcccttgagctaaaacaattatcattatagctaatctggatatgcttatagcaaatccgctttcaggtgttaatgagtgaactgtgcggatgtaatactttggccgccaggtcttaacaccttagttctcatgtgttaatacttgagttgttgcatctatatatctagcatcttggagctatatatccaacatcttggagctatatgtccaacagtcggtatgaataaactcaataggtgaaaccaagaaggttcagtttcacctgaatttctcccttgctttcacccgctgttaccttattcatcggcatttagagaattgggtgaaaccggtgaaccgcaattatcttacatagttgcatttatgaaatgtcttgcctacgtaaattacgtggagaggcaccaaaagatttcttgcagaaattagaaaaatggggtaaagattcaaaaccatatttatagcatatctccgagatgctacatttagagttgttcaagtcgtccagaatgccctctttacgtctcgccagcatccattcataaacaggttcatgaaagacgttattgaagatacgacggaatgtactaagggtatatccacccaattgtgccagttcttccactgtctttactttcttatagttttgaataacgaagtattggaaactgtttacatatttagagagtggatgcaccaagctcgaaagatcataatcggaataatagtatcccaacacgaacgctaattcttttcgtttcagagatagcaaatcccgacagactttatctcctttcaaataagtaatagacccattgaggaaatattgcagttctggaattatttttaatggagtataaataagtggaggagatacttccttcatgatatgattgaaacggaaatcacaaaacagttcgggctggataaaacgataataaatgcactcacattcagtcatagcaagcatctcaaacatagaaccaatagcctgaaggataaattcaccttccttaagcattgtccccgcatattccttactattgaccagtatttctcccttcatcaaaaaaaggataagattttcttcacacttttgagccggtttatgaaaaccacgctgataaatcacatgagtaatggcattactcaccgcttttggacatatttgacaatcccaggttccttgacaaatagatggcatacgctgactgtgtttgtttttgtttatgctgccagcaaaaatatatgaaatctttcatattgccataaaaaaagagagaaaagtgaaaaagaggttgaagagaaatatataaaacttcgtgaactggctttatcttttaagattcaagatcaataaactaacagccataggtctaatttagtaaaacctacggctgttatcctttcgtccttaccggactctatatatttctaaatatatattaatttgcatcaggtgtcacaggcttatcattatcatcttcccaattctttacatctgttgcaatatctatcttatctgctccagctggcaaagtcaacttatagcgtatactattacctataccccattttgaatctttagaaagagtaactgttttagaaccatcaaagaaagtttcgttagcactatttaccatcttcgttgttttatattttataacaatctgagcaccttcaacatcttgcggtaataacattaatgaaccatcgggcgaatctaaaccaaaatagccactggcatctgcagtgcttgcaacagttatcggataggtatatccagcagctactgtttcaccagtgctccatgtcccaacagcaacatcagcagcataagtatatgtagcatttcctccttttacacccgtaatctttatttcagtaatagtataggtgaaacttgtatcttccggtttataagagaaattaatcttagcaagaatatgtttaaaatccaaagtgactgtgttactatcagctggtttagctgtatttttagccgcaacaactaaatctgtttgttctgcagaagttgctccaatagcaaacgcaagagtaggatatccttttgcggcatcagtaggatttaccaatgttaaagcgctcggataaccaaagaactgtacatttttgcctacaggccaataatatttattatcacctgaagttatccaactaccctgttttcctgtatattcaactccatccatatacggagagccaagaagcgttgttgaaaaatcaaaatcatttgccacaataaatgaacttactttaaaggaaccaaaattcacattagtcatttctgctgctcttgatgttcctttaacaatcgtaccaatattaatctccgctttctgtgcagcattctcaaattcttcattctgtgagcaacccgtaattgccaaagcagctgtaactgccaataaaatcttcttcataactgtattttttaaagtttataatattgttatattttgtttatagcatctatttcaattcacgggtaactcaacattatcttcgggtccccagtcatcaacattgccgcccattcctccacctccatcaggattcggtggtgtttccggcttatcaacctcaatcttatcatcaggcggtaactcaatctccggtggtggggttggttttccatcttcccctgttccagcattttcaagtgtacctattatttcagtaacatcaattgttgcttcctgaactgtattatctgttttgataaatttcaatattaatattatagcatctttctcactagaagtttctctctctgatgttgacattcgcgtcggcattgtcatttcctttacttgtttgaaagcggtgaaagatgccgttaccttattgtctcccttccttacctcaaagtagataggttgtgagctacatactccacgacctttgcctatacagtaacaatcggataatccatcaatgcttcctaccactgttgcaacatactccaaacctttagcctctactgcaaaagaatattttttcaccacagattccaacttccagtctaagcgaagcacttcttcactcttctctattttcagctcatctatattcaacacatacaatgaatccggtgaccaaaccatcttttccgttccttcaatccctaaaccattgcagtttcccgtgtaggcttctatcgtttcataggactcttcacccctgattcgtatagattccgtgttatagttgtagactactaccgaataccgtcccggaggaactttcatttctccgcctcgtaccgaaaggtacttatctactttcctgccatctccgtacttcggataaaaaatcacccgaactccctccggcagttgatctgtcactccatcccaatccagctttatatctaccccacttacgggataatcatccaatatatcgcgacggctacatccagttagcatcagcagcgaggacaaaagcacaagaaacccgtatcttgtatttcgcattacgccctcctatctctttgttgttatcaaccataccaaagaaactttcgccttggtaggaccaataaagttataacgtccactatttgtccatataatatctccctcataaggagtatattttttatattctgttgtcaaataccctatgccaagactgaattcaagggaaaaatgccgtgccaattgccgtgcatatccataagtcactcccgcagctccgtaatacttaccttgatagccgtctccacgcagctggaagtcatatatcccgccttcagcataaagtccgataaaatgtccggtcaatcggtcgcgtttctgacggtttcccagccaacaacgtccttccatccctcccgaaaggagctgatagcagaaatcatgtttgctattcagccaccacggacatttatattcagtattcaaagaccacctcttgcctatcggaatttccacttctatatttggcgccaatgccaaatcatataacagattattcttcactgcaagcacagtttgacttttcaccggcccttctgcctccgatatatcgacctcacaggcctgttttttttcactttctcccacaggcttatcaggttgatctttcggaagcgcctcttcctgctttgaaacaaacaacccggagacagaagataccggttcaaaagcctctttacctaatttcgaagtttctccgacaatcgtaataaccgatcgccgcagctctggaaagatattgtgaacaatgtatcggtaagcaattccccgattcaattttcgcaacagttgcttccgtttattgacatcattcttatgataatcaatcaatatcagcacttcttcccgatctggcaagttggagtcggatgccaccaacttacgaaactccgaccaatcctctccctctgaaaaaaaatgaatcttatcaacactaacatccgaattataccgttgtaagaattcctttatcgaatcatttctccgagcagccaaacttctattataagattcatcaccatcaggagaaacaaaagttttcacattcagcgctgttatatatttcgtattcaaatttccgagaagcaaagaatctaaaattgtaattgcctgattattatctttataactaagatccactttcgcttcattcgcatcaaaacatatcactgcccgccggattgtatcattcgcaacagcgaaaaatggaatcgaagcatacccactttctggaaggcttaataaagccataagaatagtcaatatatagataccatgtttcattgtcgttcgtttctgatgacaaatatagaagttagaaaacaaaccgaatcatacttttagaacaaaaatcaagacatgaaagattctgtgaaacgattgaaacgattttgcaagttttgagagtttaaggtcaataataaacagaaaaaatgtctttggtaactcatctgcgtgataacaccgtacttctgttccgcctgcatcagcagttcacattcataggaagttctgacaagcggcttttccacatacacatggatgccaagcttcatcgcctctatacaaatcgggaaataactatgatcgggagtcgccaagaattttctacgagatattttatacccatccaaaaatttcattgaagaaatcatgtatcaaagtgggtttatgaatagatcacatttctataaggagtttacaaagcggatgggagtggtacctaaagactaccgttttgcataataaaagtcagattatcaatattcttaacagtctcacctatggtttgcaaacgcatacaagttgcatcaaaaatatccatcttatcaggagaagctaagaaatcatttacagaaatgacactaccacatctttctatagttgtattaatacgttcttctacaaaaagaagcatatccaatatgtcagcattagatatagattgcgtctttctctatatgatcgcgaaataaactacgcataattgcggttaaagacacgacatccacttttgcattaaaacgctcttctaatgactcttttatttccattcgagtaaaataatccggttcttgaagctttacacaaatatcaatatcactatcctctttctgctcaccacgagccacagaaccaaaaagtcctaacttttcaattccatatctctccccaaattcttccttaaaattctggagaatagcgattatttcatcttttgttttcaactgacactattgttataatgcaaatattaaaattaatattggaattagcagattcttaatcatattttgtagtatcactaattaaaataagatgcacaggtcatcgaattttcatcgatcccctgtacacctactactctaaattctacttcaaaacataaatagcctaattatgctgccgaatccattattaacaatcatgttagttttatccatcaaaagtacagaacataattacgtaaatagttcaaaagtgcccagaacgccatcatcattgccaatacaaacaaaacgacaagtccgattgccaaagcaatccaatgttgtgaatgatcatcagaatattctttatgaccatcattaaacttgtatattgtccgcactgtctgcgctcctgccaataacccgaacactccggcaaaaataccattatgaatgtttccaccgccacgaagtgcccgcttatcaattaagaattgaggcgtcctgctcgctaccacatacaaaccggtagctattaaagtagaaaacatcataccgactcccatcatccaatacatcaagatacccacaatgacacctaaccagattaatttcctggaaccatcaaaatgacgttcttcaccactattaatcacatcagtcaatgagtttaagcgttctatgacatcagcgtcagtaggacacataccgataacctgatcaatcaaaagaacagatttcttaatttgcttcatctttgtcggctttctgaattcatcatcatctgttttttcaatcaccgtccaagtagcgaatgcctcatccatcagcttccacgcctccgttatctcttcatccgtcattttctccggcattccggctgcaaggcgtttattcaacattccttctaccgtaaaaacctctttataacgtgcgcccttataccatacaaaaaacatatgccccacaataaataaaacaacggcaatatacaaaatcagttggagaacagccaatatctttactcccaaaggaactccgtcatccgccgcagcatcagctattgcatcagctccactaccgctttttacaagtgtcaatccattaaaggcagcatcttttccgcctttatcaagtccggaaaacgacaacttatcatctttataaacgactttgcattgaccggaaatcccggcatcaacctccggacgtccgcctacaaaagaaagagtcagttcattcccgttcatactctcgacgtaaaactcataagttgccatcaaagattcccttccaccgggttccagcatattcacttccataaatccattgcatctggcattctcattataaggattcaattgccaattaccatcacaattcaatgtgaacgcaacctttaaatcgccttctttatttgctcctagccagtcaccgctaaaaacatcttcctgcgcaaatgcagtcatcgaaataaccatcattacaatggcacacaaatactttttaatattcttcataatataataaaattaatatttcaacaccttggctgccacgttcttaaattgcggcatagcaagcccgatagaagctccaatataagtcggatcacaaattatgtacttctttccgcttacagttatataatctccatcaatgttttcatcaaaacagaccgctgttgccatgtgattgggatattccaacaatacaacatcaagccccataagagtacgtaccaaataagagtataacacagcacggtcttcgcaatcggaataaggatagtagaacagctcatccacaaagaaaggcttttcataaccaaactggtcaccatctgtcttataatcaaaagctgtctgcacgaaattaatcagtatattagcggcttccgattgttttttcccttgtacggcagcttgcaatgatggaagcaccgtctgttgtacttcctgactgacaggagctcccacatagacagaaaagtcacattgcggataatccttatagaaggaaataagtcccgaatttactttcgagcagactttgacggatggataagctttcgcttgcaacgttttctccacgtaagttcctgaaaagagttgaggagcagtgatattcatatttaccgggttcttcgcattggcgaaatcacggttgtaagtgtaaatagaattagttttatccggggtagtatcaaacctgtaatagtttactccattcaaagttataaaacaggtagcataaatcatgttacccgaagcatagaataaagtaaggcggttatccatacgcgccaccttaaccctatatcccgattgagaaaggagaaacatttgcataagagctatttcatcggaatgagtacttccacatagttcagtagcaactttcctcgtcaacagcagataaccatagtcattcagggcattatcctttttaaaagccagacagtcgtctatcaaaggctgatagttgctacgcgataacgtctcccatccggcagaaatatctttctctgcaatcccttttaaagtgagccggttcttcaatgaagcattgacaacacaatctttactgtagaacgaaaactctacaccggaaagtgagcgtttggccggaacggtttcttcaggcttcacttccggttttatttcagggagcaccgcaaaatccttttccggttctacagccacatctttacctcccggtacaaccggaacctgtgttttcccctttgaaggagaaaatgtcgcacttggagtcactgtcggaatggggagtcgtgtcacctcccctactttaacctcttgcggttttgttgccggcttcttatggtcaaagctgaccggttttacaggctccggcctttgaggacgtgccaccggcttctgcaagtcatactctttccaggtttctttcagaaattcggcaaattccttattctgttcgctcacaaaatcatcaaactctttttgctgctgcttcacaaaatcgtcaaactccttcatgtctttatctatttgcgcaaaaagactaaacggcaaacacaatgaaaaaactaccatagatagtattcgtatcctatttttcctcatttccttattatattttgttgttctgttatctgccaatccacatacagcttattattccgtatatctttgataaagggggaaatggacaagacagcgacaaccttctcccgatacaaaccacaaccggaatcagtgccgccattgaaacgatcgtccacctgcttgacatttacatcagaaaacggatataacaacagtgccttcaccaaagaagacatataggcattccaaaaggcattcctcatatccatcttctccaatccgtcctgatctccaaaaccggcatcttcataccaacagccttcctgtaaagaacaaatttcaactccgttcatatatgaaattatttgaggagatgactgtgttcccttaagctgaaaccatgactggtctgattgctccctacaactatccgattccaacaataaattgaatttcacctcttcttcctcaaccctttctttcgtaaacaaaagcatcaactcactaatggaatgataagaaaaatcgcaactatcattcgatggagtaaaagatacctccagaaatttctctccaaatatagaagtatattcatgctcaatccggtaggaaacatgttgaacgggatgttcgatcactcccaatacaagcattttgtttctttggtcttcgtatgtattactggcagtctccatggtggaaaaaacgtccgagagaagtctcaattgtaccccttgctgcaatgaatacagataagccgctctttgcaaagcaagcatccttgcagcttcggatttcatacaaggatcagatataccaactacccggcctttccgttgagaagtaaacacccattccggcaaagtctcccgctgtcccggtctccagtcataagattggttataaactgtatcaacaggcattgcctgtgaaaacacatcaataccgggagacaaaagcaactggataataaaaataactacccaattatatcttatatccgacaaattaagcttcatcattcaatcttcaaatagttgggtagttattaaagagatcattactatccgcaatgttttaaacaagctgcttattgggcgtttttactcatttcttcttcaaatacctttttgaacttttcatattcaaagtcaatgcgcaatttgtcatcattcttaatacgatttgccatagcattcatgatttcctctcctgccagttcaagagagacatatactttgtatttaccatcaggagtcttcatggttttttcacaaattacacgcgtaccgctcaattcctgttccactaccgtacgggtcaatgattgataacgacttttgctttcatcattttcaccttgctgataagaggaaacataactatcggttaccgatttcacttttgcattgatagcagtagcaatttcagcccgggcctccgtcatcgcttttttctttgcaatagacatatccgtagaaagtcccatcgaactagctctaaaatactctttgttcgtttgaaattccggtcccgaacaaggaacattaatttctacgtcctgttgcactgccggttgctgcactgtttgtgttacaggttttgaactaccgcaacttgtcataacaacaatagttagcaatgctgttcccaataaattaattcttttcatttcaagtcttttttaatgttaatatatgattcatttcaagcctctcaacttcactatattatttttgaaatccttcaattgcagcagtgccacagattgcaacttactcacctcaataaccatctccgtaggcagatcaggcacaatgagcgcagtgactctgcggtcattgaacttagaacccagtttgagactgacaatcggagattcttcacctttttcgtttataaccgtcagatttccactatataagtccacttcgcaatcgtcagcatttgtattcacaatcttaagatgtatcctcgatttgtctcccaaagttgcaagtttgtcaaattcaacaaagacaccatccaaccattcaacccgaattgccttttgattctctggtttggcggacttaaccggaaccaaaggagcaggaataacttccggcaccacaacagggacagatataaccggatcagcttctttttccggtacggaaggaccgactaccggaacaggaacatccggcaacatcttctgtctttccggaatctttccggttctgtcgaatgttattttcttcaattcacgcgcaaactcccgattcaaccgttttatcaattcacgcgccgccatattcttgccttgagaagcggacttattttcaggtactaatgtccgttcatcattaatagaataattcaataggatttgccccgtccggttattttctattttaatccccaacgtagaaaagaattcgatgaagttgtacagttcacccggaacggtattgcctttacgacacttattatccaatgtaacgataatgtcggcttcagaaggagatgcaactacgttaaagaaatgattgttcagcaaactcttcacagttcgttccaccgtctctatatcgctctgcgcacttctaacataagcagaagtctgtgtctgcgccgtgttgacagtcaacgttgctccgggaagagaagaaagcatttgtttgaataaagctgcataacttcccttccggaacaagctgaacacatcatcaattaatgaaattccaatttcctgctgtgcctgtttagaagtaatattgcgcacataaagagcggcaactcccgattcgtcggtgggagacatggaagacaaatctcccgacccggaaacaaactcggctttcaaccggatattccttaacggatttccattacggtaaacacctatagcaataggctcccttataccttgaaacggcgtggctgaaacggttgccggattcagaacaatcgttattccatcaaatactccggccaaagccgcatatagttcagtcgccagattaatcgtctttccttcgtaagagcagaacaactcctgattaagcaccgagcgtatagcctccattccatttgagaataattgaatggcagtcattaaatctccctgttgtaaagtaatgtgtcccttataccaaaaatcgaagccgttacggattgccttctgacgacgtgcttccaccaaggccgcataatcatccttattcagttcataataaacccaatactcattgtcacttcgccaggaatccaccagacgaaagttctctatttccgcccgggcttctgtacgaatactttctgcgaaggtttgtttcacattaccatcgtcctccaacgtattcaacaaagaattggcggcaatcaccacttgaatttcagatacaagatcagacaaagcgttttgctttgccttttgctgataatctccttccgatatttcagccattcctattccgatgtaacttaaaccactaacaggatgctgtttcacccagtcaggacggttcgtttgttgaccggaaagcggaaagcaaaaccatgaaatcacaagaataaataaaagccaatgtttcatacgtccttgatttattgaatagtcaaatagatggtacttccatccactctatgttcactatctattccggaatcattcagataattaaccagattatccgcaaacgtgatgcaatccatcggcaagccgtcgctgtcctttgcaggaatctgtatcgaatcaaatatcagactatcgtccacagcaccttgaatatggtagcgtcctccctgggcattttttcgtacccaattgcgtatatgcgccgaaagagtagtactaccgtttatccgactattcatcgtattgatagcattatctgcgagactaacccgaagaacaaccgtattcccctgttgaactttccgggcaaactctttcgagatatctttcagaaaaccatccagaacatcttgtgccgcatatgcgcataacttatccacgtccgtcgtcctaaagcggttcgtccagcttttccggctagccaaatctactccggtagccgtttcacgagcagtcataatcaatgagactctacttcccgaagctgcagatatgtctttttgtaaatcaacaatcacatagacgtccgctcccgaattcatcaacaactgcttatcattggaatcagcattcttactttcccattcggaagcacgcaaagttcctgactgttttccctcggcagccactgtcttcacgccaagcttaacaaatccctcctttaccgtacttacggctatacgaagatcaaaatcattcttcagaatatcagcgtatgagcttcggtcattgcttttataggggactaccatgattgtcggcaaagcaatttgttgccgggtttcctccatcgacatttcttcctggggtctcgtcatcaatttgttccgtatcaagtcttttttaagcgcacctaataagatttgagccgttactgtaccattgtatagcttggaagattgtcgtaccggatctcctaccgtttcatagttcttcacaaagagcatataacgtgaactgaaaaactgattcatatagtaagaatcttctttcccgacgagcggctgtccgttttccactccgtcaatgccgttgagaaatatagcattaaagatcgacttcaatgccatattatatacatctttctttttttcggctgttccggaagcggtgataacggctatgttatcatctgccttcatacaagttacgtcattggagtatgactcctgtgccatgaaatgaatagtgtatacaactagcaggttcaaaagcagtattcgtaacttcatcatagtccaagtccgcctaaaaaggtattttttcgagaaagaataatcaatttcttttcttctttcgatgctttcattatctcctcaccgcctttgctcacggtacataaagaacgcgttccgctcaatacttctttcacattcaaacgtccgacttctttcaatgacagttctccagcaatatccatctctatgtaaacgataaatttctggcctttttgtacccctctcttggttccaagatcgatatatacagtttgtgctttatcttttttggtactctcaatctgtacaatcgttcctttcattttgaaatactcgtcaacaaaatcgtccatgcttattactacataatccaaagtcttaatgatagcttcatcaggagtatcgccaatattcccggtcaacccctcgtgagtgaatgtctgggttcctttgagcgtaccgttagaagggtctactattttcaacgtgtaagaaacactcccctgataataggtcttccctttactatctgtttttttaactccctgcatactggtaatatttccctgaataagatattgggcgcctaacgttgtcatgacctcgcttctgcaaacggcatctcccatagcagaagcctcttggcgtcttttcgcttcagtcttcaatgcttcattagaatcaacatcaataagttctacacgatccatcttctggataccttctattactttattacgcaatgcttccgccaaaatattactgatagtaccgggacgcgagaaataatcaatatagactctttctttaccgttttcatcggtttgtgcatagcctaacattggaattaggcaaatagagaacaatagtaaaatcttcttcatgtctgtttattatttattattaatgctatgtttgttttttagtgcaatatttcgctcttttaatacaatatagaatgttcttttttcaataatgatttactgttatgaatgattgtgttttctctgactgcaaagttaagcacacattaaggtgtattgtatacacaatatttactacaaccatccgttaaacgaatagttatctccaaatatcaatgagaaaagggaaaagagtggtatgttcaataaaacgaggtcgttttcccgtctccaagctatttgcaccatcgcattttccacagttctctcgaataagtataaaatagcatttgttatatccactaaaattgttacatttgtccaataataaattgcttcccaataacaagatacatggaaacagatttaaagaagatagtaggacatcggctgcaaatgcttcgtatggaaaagaatcttacacaagaacaaatgggagaaaagttgaacttatcaacaagtgcctattgtaagattgaatatggtgaaactgacctcacgttaaccaggctgaataaaatagcagaggtactaaatatgtctgcattagaactatttaataaaatagacgggaatgtgtatgtcaataattccggtactatcggaactaatattggagtcgctaaagactgtagtagcgtgcatatcgaagcggcagatgatcttcgtgagctaataaaagcaaacagtcggctccttgacatgttatataaacgtatagagcttttagaaaataaagtgctcttatagtgattatacgcctagagaaatctcatcaaggtttaaaatagcagaacataccggtcatcgagttcgaacagataaaggtgctcataaacgttctgcattgaatatatacgaaaaaaaggctgcaacttcgtaaaagattgcagcccgtttttttattgggtaacctctataccctaactcttataagaagtctcacgcaaagatatcgctccgcagaatataaccgataacatctcccttacgtacggtagcgccttgttgtgcacatatttccaccacacgtccggtaaatccagtcagaatcttttcatattctccccatggagtagaaagataacaaaagacttcgtcatgctgatatttacgtccgatgaaaggagcaatggatggaccctctacggaaacttcccaaagtacctgcccgttatcaggagcaatgaccgggtctgccttggcgcgtttcaacttcttgatatcttcctcggaataaccactctttgccatagatgcatccttagcatgttgtaattcatcctcaaaacgtttcttggcaacacccgacttataatcgcgatactgacgatcgtgcatagccagttcaaaaagttcttcgtcatcctctccatactcccaaccattctcatccatttccttgcgataatcatccaaagcatccggataattcaactgcggatcagtatcgacaaactcatatcctttagacttcgccaattctataatctccggagcaagcgtacccggcagacgtccactcttacccagaatcatatcccaagtatggttatctatcattgtccaacgttcttccccttttacctgctgcataagattcattaatgcaacatttttcacatactggctgaaaggagtcaccaaaggaggataacccaacttaggccacacatattccacttcgtcgaaaagcattaccagcaaatcgtcaagactaagttctggttcgttcttactctttaatatcatattgataccggaatgcactcctttcaagtctgccatcatggaacccatcataccacccggcaaaccacatttcaataaaagcgaagacatatatttgttggtaggatccatgaagtaacccagaaagtcatcaatgaattcctgcgtcatcgcacgagccttcatatatgctttcatattaatatccggaacctgaaaacctaaatctttcaacattgcctgtaccgagattacgtccggatgcactttgccccaagacatcggctccatagctacatcaatgatatccgcaccattctcgcaaacctcaaggatagaagccatagacaatcccggcccactatgaccatgatattgaatcaatatatccggatgtttctccttgatagtcctgaccaattgccccaacatacccgggcgaccgatacctgccatgtctttcaaacaaatttcaggtgcaccggcctcaatcagttgatcggcaattcgggcataatactcaacggtatgcaccggagaatacgtgatacaaagagttgcctgcggaatcatacctgcttccagagcatatttaatggagggaataatgtttctcgtctcattcagtccacagaagatacgggtgatatccaccccttgtgcatgcttgactttatacattaatttacgcacatccgccggaaccggatacatacgtaatgcattcaaaccacgatcgagcatatgtgtttgaatgcccgcttctctaaaaggtgcagtaaaagcacggacagctttattaggattttcgccgtacaatagattcacttgctcaaaagcacctccattcgtttcaactcttgtaaaacagcccatctcaacaatcaatggagctatacgtacaagctggtcaacccgaggttgatacttaccggaagattgccacatatcccgataaacaagactgaatttgatttcctttttcatcatagccaataataagtgattttttcggttaacttcacatatacaaatataaaggtttgttttgacatatagtcaaaaacaacctttaaaaaatgggtgaatagagatattttacatcataatgaaagcaaacaacgtctatattcttccaactataataaataacaaatcaaattgtctaatgttcagatatatccccttaagaatccaaaggcttcacgaagtttattcatactaaggtttgcacgaatgcaaatcgcttttcaaagtcatcattcggtataaaaagggtaagataaccatcaggcataatccatctatcacgaagtttatcatattcaaaagtactattgcaataattaatataagatgttacattagtggagtcattaagataaagaatagatttattacagatatcattttctaaaacacaaactaagacagcattgtccactacaatttcaatgcctttacttgcttcctccttaaacaagtattcatatatacacatctcttttttaaaaaataatctttgaatgcggctacttgtattagtgagcacgcttcttcccacatacagtaaattttcaaagtgtgaatgcaatttaagagtatccatttcatcatttttttattgttattactctgctaaatattttatgttcaacattaaaatccataatacaatcatatatgattgtggatatgcaaatataaatacttttctttgaaaacaatcatatatgacagaaattatgctcgataaacaaaaaacattaaatgagataggtactagaattagaagattacgggaaagtaagaatctatctattcaagagtttgcagataagcttgaaatagaatacaataatgtcattcgaatagagaaaggaagaacaaacttcactattggtactcttgtaaaaatcgctaatacattagaggtgaatttaaaagatatagtatagtcattaaagacaatgatatgtggctatatactttattatatataatcgtttgtacaataaagtatatagctgcctaaatttcaagcaaacttattaagtcttagttaaagttccaaaatttctcaacaaggaagttatttcaaagtacaactcaaacactactaccaacattgccagcttgagaaacatattatcacaagttccatacttgttagataaaacacctgcaaatgtcacaattattaaccacgcaaaaaattcaatatagaaacttctcgtactgttcatttcaggacaccgaaaaaagtttatcttttctgcataaacgacttttgagtttctaataaattctcaaggagtttataaaaaacggtatccaagtttattaaaaatctgaatgtagctttcagaaggattcgtgttgaatttatgcaacaaaaaaggctgcaaaccctataaaaggttgcagcctcaagcttttaatcgggtcgtctataccctaatcctcataaggatctcctagatgttttgttataatcttatactgttttatcgtcagataacgatgattatacggcatataaccggtcggtacaagttctttggtcaacgggttatagtctttaatccatcggcttagacaacgcactgcatttttactggttgtacatccggggaagtacaatgcagctaatacagcaaaagataagattgtctcatttcgtttttaaagttttaatttgtcgtttcattgtttctttcgttatacaaatatacaacatcaaaaagcgtttgtcaagtcttttgggattttgccgttaatataaaggattatttatccatacaaagctaattatcaaccaattaagctatcattttatttttttcaatatttgacattaaaattattgcaaagcacttaaaatatagcaatatctttcctttaaaaggaacgccccgttggttttaaaggaaagatgccttggttttaaaccaacggggtgttccttttaaaccaagaaaacacttatattcagaccttattttctaattttcccagaggctgtaatggtattcaggaagacttactttcctccctattacctatcccaaaaagcatcctactttagccattaagaacgcaccgtgtacgataacagtgaaaatcagtgaaagaatttaaaagagaaacaaatacaacagaattatttggaggttagtttgcaaagacatacatttgtcatgtgatttttttcatagtattagatttaaggttaacaaaggttggagcaaggcgttgctcctttttttatatccatatatgaggttagtctatacgagttaattcaataactgatacattcctcctgccaatacacgaactactcctttcatttccagttcaaaaagaatagcatttatcttatgtacgggaatatctgcttctactaccagagaattaatctgtaaattcccctgtttctccaggatagagacaatcttctgttcttcttcggacaagtcgagaaaaagactacgttgcacatttactttttcggaagaagttgttggtatattccatcccattgcctgtacaagatcttcagccgataatagtaaggaagccttattatctctaatcaaccgattacacccctttgaatattcatcatttatccggccgggaaaagcaaaacaatcgcgatgatagccttcagcaagttcagcagtgattaatgagcctcctttttctgccgattcaatgacaaccgtagcatcacacatacctgcgacaatgcggttacgactgacgaaattatgtttgtcgggattcgtaccggacagaaattcggtcaatagtcctcctttttcgagcatatcaatggctgttttccgatggacataaggataaatacgatccagaccgtgggcaaggacacctaccgtaggcagatcattgaccagcgcttcacgatgcgcatgaatatcgattccgtaagcaagtccactgaccaccaacacatcaggacaaagtgttttcagatcgcgtaagaaagaggcgcaaatccgggtaccataatcagtggcattacgggtacctaccatatttattatatgcagggaattcaaatcggtatttcctttaaagaaaaggacaataggagcatcttcacattcccgcaaacgagaaggataagcctcgtcatggaaagtcaggcaggagatccggttcttccggataaattcatattcctgttcggcacggatcacagcttgtggacaatccaacgcatctaccacccgttgactcacttcaggaatacgttccggtatttctttacgcagacggaagacatcaacagcattattcattccgtctatcagatgtttcgcccctatgtgcccgataccgggcaccattgtcagggcgatactataaatctgttcttcctcggaactgctcatttcaggtaaggggcaaagacgctatcgaataattcgctgtcactcaaacgtccgtttaccacacataccgtttcaacagtggatttcactactactttattatcactcttacggaaaatatcctgatagaatacatatttgataccttccttcttcatatagagtttagagacaaactcgtctccgcttttcaacggcgttttgaatgccatattaatgcgtgccactaccggatcgactccctgttcgtggagtgcagcaaaactgatacctaccgacgtcagaaactcatggcgggtatgttccaaataatgctgatagttcgcattattaacaatcccttgaaggtcgcactcgtaatcacgcaccttcatttccaattcatagatatagttcatcaattaaaaattgaagattaaaaattaaaagttgagaaatagcagttagcctcttttttgctcaatatcgagtcctttgaacttcttcagttcttcggttgataccagtttatacagcttgtcactggggcgtatcttatctgatttcatggagaagtgctggcctttcttcacagtctgcacggattccaagtcaacacgggcttcttccaaagtcatgaatagagcacctgtggtcggtccggtaatgagaagtttatcgcctacgctaacttccgcagcctctaccagaaattcggaaactccaatgttagagaagtatttgatacctttacctacatatatcttacgttccgtagctgccgagccatagtttctggtccattcgcctaaacgttgtcccaaataatagccatcccaaaagccgcggttgaatactgttttcagacgttcgtcccaagctgcaatcttttcatcggtaaatgttccttccagataagctttgatagcctctttgtaacattctaccactgtacgcacatattcaggtccacgggcacggccttcaattttgaatacacgcacaccggcatccaacatcttattcataaagtggatggtcttcaaatctttcggtgacatgatatattcgttatcaatatccagttccacatccgtctctttgtcacggactgtataggaacggcgacacacctgcatacaagcgccgcggttggcagaatggttcatctcatgcaaagagaggtaacatttacccgatacagccatacaaagcgcaccgtgacagaacatctcaatgcgaatctgttcaccgctcggaccacaaatatgttcttcctgaatctggcgatagatttcggctacctgctccagattcaactcacgggccaatactaccacatctgcaaattgtgcgtagaattttaaagcctctgcattggagatgttcagttgagtggaaaggtgtacctcctgccctatctgacgggcatagttcatcaccgccacatcggctgcaatcaccgcagagattccggcttccctggctgcatcgacaatggtatgcatcaatggaatatctttatcatagataatcgtgttgaccgtcaagtaacttttcatcccgtgttcatcacacgtacgggcgatctcccgcaaatcatcaatcgtaaacgtattggccgaacgggcacgcatgttcaggttttctataccgaaatagatagaatcagcacctgcctgaatagccgcagcaagagattcgcgcgaaccgacaggagccattatttcaaaatctttcaaactaagactcatagaatatatacttatttgtatcagttaagcaaatgaatgcgtacaaaggtaggcttttttccgtatttttgcagcgaaaacaagaagttacttcaatcataaacagtaaatatcagattcatatatgaagataggccaaatagatttgggtaaatatcccatcttacttgctccgatggaggatgtgactgatccggctttccgcctgatgtgcaagaggttcggagcagatatggtatacaccgaatttgtgtcgagcgatgcgctgattcgcgctgtcagcaagactgcgcagaaactaagtatcagtgatgccgaacgtcccgttgccatccagatatacgggaaagatacggaaacgatggtggaagctgccaagattgtggaacaggcacaacctgatattctggatatcaatttcggatgcccggtaaaaagagtagccggaaaaggagcaggagcaggtatgttacagaatatccccaagatgctggagatcacccgtgcggtagtagatgcggtgaaaatccccgtaacggtcaagacccgcctgggatgggatgctaacaacaaagtaattgtagagctagcagaacagctacaggattgtggtattgctgcactgactatacatggccgcacccgtgcacaaatgtataccggagaagcagactggacattaataggcgaagtgaagaataatccacggatgcatattcctattatcggtaatggtgacgtgacgacgcctgaacgcagcaaagagtgttttgaccgttatggagtagatgctgtcatgattggtcgtgccagctttggtcgtccatggatattcaaagaagtgaaacactatctggagactggtgaagaattaccaccgctaagtttcgactggtgcatggaagtgcttcgccaggaagtggtcgacagcgtaaatctacttgatgagcgcagaggtattctgcacgtacgtcgtcatctggctgcgagcccattattcaaaggaatccctaatttccgtaatacgcgtattgccatgttacgggcagaaacaaaggaagagcttttccgcatatttgaagaaatcacttcccaacgtaaagagaatccggaagtttaatctactatagatcataatcttcatccgcaaactctgattcctgcggatggagattacctgtttcaaaatacagaagtatattccaattttctacttaaacatcggttgtgcaaaccacttcttaaacatccaggtcacaaccacatacaataggaatgcagagaaaaaccctacaatggcatcaatcacataatgtgcctgaatatatacggtagccccgcaaagcaacatatagaaaggtatcagacaagcaaacaatttcttgctgccacgccatgccataatcatcaaaatagtagaaataccgacgtgtgaactggggaatgctgccgtaggacgttcgcctacctgctgtgagccttccactaagctataaaagaatccatgctgataacccggtccgggaagtaattcctgattatgattgaaatagtcaccgatagcagggaaaatacctttagatacattatcaatcccgatggcagggaaatagaattgaggccccgcgacaggaacgaatatataaatcagataatagataaagaaggaagtgacgagaacaaaagacatcttttcgaaccactcaaacttataaatgaaataaaacaatgccacaatcagcatcatcggataataaaagaaatatcccatattaaatgcttcactgacgataaggtacggaaacgtatggcaaaaccagatagcaggctgaccattgaaaataaactcctcggcagttgcaaatacatggtctaaattcggaaagaaacgattgaactcgaaagtatccggataccagtaagacaatagactcatctggataacaatgcgcacaaacgctgaaaacttacagggggcaagacgataaagatacatcaacaaaaaggtcatcgccgcgatcatagccctatccagcaacatgtgccatggatgatccattcgctgaaacaggaatagaatcaatatggaagtcaacagattataaatcagtgtaatcttttccacagcaaacaaccctttccgggtttctacgcgcttaaataagtctaaagccatccttcatttttataccaggcaatggtttcacgaactcccttttccaaatcatattcgggtacatacccaagttctttcattaccggggatatgtcgcattgccagttgcgttgtttcattatcttatatttatccgaattcagggtactgctcctcccggaacgtgtagcaatgaattcagcgaacaaagatataacttttagcacaattaatggacatttcaagtgaagaacaaacggattgcccaattctttttgtatcagatccgaaaaggcacgacttttatagattttcccatctgtcaggaaatacgccttttgaaccacttttttctccattcccagaaaaatcgcctgcacaatgtccttcacataaacaaaagtcaagtcctggcgtcgaaaaccgaccgaaaagtctacatgcttctgaatggacttggccatcaggaaatagtctgactcacggggaccatagactcccgtaggacgataaatgacataaggaaaaccgggaatactctgaatatataattccgctttcaatttactcaatccataagccgtattaggcatcggagtatcttctccgcttatcggagtataatccttctcacgtacaggtccgaatacactcaacgtgctaatatatataaactgcttcggaaccatattcaattccttcagcgtgtctataaaatatttagtctgaagataattcacataatcaaaggtctttttatcagaacactttgtcacaccggcgcaatggatgatataatcaaatttgctgtaagtacctttatgcccggagagttgggcgcgaagctcattgggatgtgcaaagtccagttccagaaagtgaattttccggttctttaaataccgcttgctactcgtggggcgaattccggcccacacaccaaactttcgtttcaacgcttcctccacgatgaaacttcctataaaaccacttgcacctgtaattaaaacactctccattattacttccctggttctacatgaatattgattcaaaaaatatgatgccacaaagatacgataaatataaaataaaagccattttgcttttctcaattattatttgtttatttgcaatgcgatttatttactattcaacacttttaaagcacgtggaagataaggccgattttgattttctttttaaagagtactatcctcaactttattattacgcatttcatttgattaataatatggaggctagtaaggatattgtcagcgacgccttcgaatttatttgggccaattatgctaaaatagataaagccacagctaaatcttatctatatgtctacgttcgcaacaaaagcattgatttcctgcggcatcagaatacacacgaacaatacgtacaaatctattccgaactgaccaaaagttatgttgagacggagtatcaggagcaggatgaaagaatgatgcatatcagtaaggcgatggaaaaactgactccacataccaggcatattttagaagaatgttatattcaacgcaaaaaatatcaggaagtggcagaggaattaaatattagtgtcagtgcagtcaggaagcatattgtgaaagcattacaggtgatacgtgaagaatgtgcaaaaaaatcataaagcaggtgtctttattttatgattaaacgtaatataaataagtatgatacagtcgaacagtgatgaataaagatattgacaatatagatagtacagataaatctgtagagaaggcactcgacattatggagagctcttcagaaataaacgtcgaacaactgcaggaaatgcttaaagatgaagaaaccctgcaggcttgtcgcgacatcatggatagcagcctcttcctacaacaaaaaagtggaatggaactacccaatatagagatggagctagaacgattcaagaaaaaacaatacacggcaagaatgcgttccaacttctggaaagtaagtatgggaatagccgccatgattgccgttctatttggaacttactatcttatcaataccctgacgacccctgccctggagccaatcacagtatttactgcggatgctgcccctcaacatatcactctgcaaaaagataacggagaaaagattgtattagacgaaccgcaatcaaacaatcaaaccttaccacagaaaatgatctcaaagtccgaaaagaaagaattggattacaggcaagtcatttcaacgaccactcaaacacatgtactcactgttccacgcggtgaaagtttcaaggtagtgttatgtgacggcacggaggtctggctcaatgccaatagtaactttgtctatccaacggcctttattggcgacgaacgtatcgtcactttagaaggtgaggcttattttaaagtggccaaagatccggagcgacctttcatcgtaaaaaccaaaactgtgcaaacccgcgttctcggtactgaatttaatatacgcagctatactcctgaagatactcatgtagtgcttattaatggaaaagtagaagtcagcaataccaaaggaggatcatataccagactatatccgggagaagatgcacatctgcaatctgatggcaactttatcctggcagaagtagatctagactcctatgtttattggaaagacggctatttctactttgacaatgtcacattgaaagatattatgcaaaatttgggacgttggtacaatgtaaacatagagttcagaaacaaagaagcgatggagtataaaatgcactttatatccgatcgtaccaaagacctggaacatacgatctcattacttaatagaatgaaaaaagtgacagtcaccttgcaaggcaatacgcttactgtagactagatttttattgcataagtataactaatctatgcaaaatacaacaaaatatcacttttattaaaaaataaatcgcaaaaggggtatccattttttcttctcatacgcactagttatataaacatgttcaaaatagtgttattaaagacaaacgtatgagaaataattggaacctacttattgtgtgttttctatgcgtattatgtttccggccctaccaagtaaatgctcaggtgcaatcgcaaaagaaaatcacgattgaaattagcaacgaacggttgccgtccgtactaaaacgtttagaaaaactatccggatataagatcctgtttacgtatgacgatgtcaagaaattcaccgtttctggctccgtcaaggataagagtatagagcagactctcgatataatcttagccaataagccactggaatatcatattgaagaccaatttatcacaattactatcaaaggtccttccaaacaggcgaaagtattcaatgtgaaaggagtggttatttccggtgatgacggacagccgctcattggtgcaaccgttgtcatcaaaggaagtaagtccggtgtattaacagatatagatggaaaattctcgatagaaaatgtatccaataaatccctgttacaattttcctatataggaatgaaaccgcaagacctgactcctgctccaaatatgaatgttacattaatgcctgatgtacaaacattatctgaagtagtagtaacaggtatgcagaaaatggacaaacgtctgtttacaggagcaactaaacaattgtccgcagatgaggtcaaactagatggtttgcctgatatcagccggggacttgaaggacgtgccgcaggcgtatctgtacaaaatgtttccggtacatttggtactgccccaaaaatccgggtacgtggcgctacatctattttcggtagttcaaagccactatgggtggtagatggagtcatcatggaagatgctatcgacgtaggtccggatgacttatcctcaggagatgccgaaacattgattagttcagctattgccggattgaattcagatgatattgaaagctttcaaatattgaaagacggatcagcaacctctatctacggtgcgcgagccatggcaggggttattgtagtaaccaccaaaaagggaaaagccggtgtcagcaaaatcagctataccggtgaatttacaactcgtatgattcccagttataaagaattcaatatcatgaattcacaggaacaaatgggaatctataaagaaatggaacaaaaaggatggctcaacaatagcgatacttaccgtgcaaaagatagcggagtgtatggacgtatgtatcagttaatcaatcaatacaatccggttacaggacaattcggacttgccaacactccggaagcacgtaacgcttacttgcgtgaagcggaaatgagaaataccgactggtttgatactttattttccaacaatatcacacaaaatcattctgtcagtatcacttccggaacagaaaaatcttcattctatgcttcattaagtgccatgtcagacccggggtggtacaagcaaagtgaagtaaaacgttatacagctaatttaaatacaacatataatatatataagaatttatctataaatttaatatccagtgcttcctaccgtaagcagaaagcgcccggaacactaagttctgaagtgaatgcagctagtggagaagtcacccgtcaatttgacatcaatccatattcgtatgcactaaacacatcacgcgcattggatccggcagtcaactatacagctaactacgcaccattcaatatcctccatgaattggataacaattatatggacttaaacgtagttgacgttaaattccaaggagaagtaaaatggaaagcacttccagaattagagcttagcgcattaggagcagtcagatatcaagcttcttcgcaagaacataatattaaagaccactcgaatcaggcaacagcatatcgcacaggaatggatgacgccactattcgtgacaacaataatttactctacaccaaccccgacaatccttatgctttacccatcagcatactgccggaaggcggtatttaccagcgtaaggactatcgcatgctgggagtagactttcgtgccacagcatcctggaatcatttatttgcagaaaagcatataaccaatcttttcgctggtatggaggtgaatgatttaaaacgcatgcagaattattttcaaggatggggaatgcaatatacaatgggcgaaattccatcgtacgtatatgaatttttcaagaaaggtattgagtccggtgaaaattattatggattaaaccataccacaacaaggagtgtagcaggttttgccaatgcaacctattcgtatgatggccgttatacagtaaacggaacattccgctatgaaggcaccaaccgcatgggaaaaagccgttcttcccgctggttacctacatggaatatttcaggagcatggaatgtacatgaagaaaatttcttcgaaacactcagctccgtgctgtcacatttgacattcaaagcatcctactctttaacagccgacagaggtccggaatatgtaacaaattcacatgccataatcaccagctattcaccattccgccctttcaccagcggacaggaaaccggactttatgtatccgaccccgaaaatagcgaattgacttacgaaaagaagcatgaattaaacatcggtgctgatatgggattcttagacaaccggatcaatttctcaatcgactggtataaacgcaacaactatgacctgattggtataactccgacacaaggagtaggtggttctatttataaatatgccaatatagcctccatgaagtcacatggtattgaattcaccatctcaagcaagaatatccaatcgaaagacttctcatggaatacagatttcatcttttccaaagcaaaaaatgaagtgaccgagcttaacgcccgttccagcgtgatggatctggtttcaggctatggttttgcgcgtcagggctacccggtgcgtggtttgttctctatcccatttgtcggcctaagttcaaatggtatcccaatgtataatatcaatggaaaaataaccagtactgatattgatttccaaacacgtgacaatatagactatctaaaatatgaaggtcccactgatcctactataacaggtagctttggtaatatcttcacctataaagcattcaagctaaatgtatttatcacctattcatttggtaatgtagtacgtttaaatccgtgcttcaattatcaatacagtgacttatcctctatgccccgtgaattcaaaaatcgctggacagttccgggtgatgagaaacataccaatatccctgccatcatttccaaacgtcaatatgaagataataaagatttgatgtatgcatataatgcctataattactctacagaacgaattgccaaaggagactttattcgtatgaaagaaatttccttgtcctatgattttccaaaatcatggattacatcagcaaagatatccaatttatctttgaaacttcaggctaccaatttattcctaatctacgcagataagaagctaaacggacaggacccggaattcttcaataccggtggagttgcctcccctgtaccccgtcagttcacattaactcttagattaggattttaaccattcagataattataaaaatgatgaaatataaaaacgtattatatacagcagtcatttcaaccttatgcctgggaataacctcctgtagcgattttttggatgaaatgccggacaaccgaactgaactaactaccgaagagagcattaccaaagtattggtatctgcatacccaatgaccaccaactgtcatataggcgaattctacagtgacaacattgatgaaaatagtaaagcatacagctatcttttccggttaaacgagcacttgtatcgctggcagcaaaccactgaagagaatcaagactcacctcatgccttatggaatgattgttataactcgattgcatcggccaaccaagccctggcagccatcgagcaaatgggaaaccctcaatcattgtcagcacaaagaggtgaagctctaatatgtcgcgcatataatcatttcgtactagctaccacattctgcaaagcgtatggtacaaatgcagataaagacctaggtataccttacataaaggaaccggaaacatctgtaaatccacaatactcacgcggaactgttgctgaagtctatcaaaatatcgcagccgatttagaagaaggattgcctctaatcgacgacaatatttactcacgagtgaaatatcattttaataaaaaggctgcctatgcatttgctgcccgcttttatctatattacacacagccggatttttctaactgccagaaggttatcaattatgccaatatagtactcggcacgaatgcttcccaatatttacgtgactgggctgcattaggagctttatctcccaacaagaacatacagccgaacgcttatgtagatgcagataatcgggcaaatctactggtaatatcagcagcttcatattggccattggtttccgatccgggttatgccaactgtgaaagatactgcatgaataatattactgcctcggaaagttgtaaatccgaaggtccatggggagaccagtcaagctaccaccaaatcccatttgcgcctggtggctctatcaagaacggattccgccgtttagtcatctatcagcagttcacatcgggcaacagctgggtcggttatatgctgtatcctgctttcactaccgatgaagcattactttgccgggctgaagcttacacattactaaaacgttacgacgaagctgcagccgatatagacgcctggcagaaagcctttacgaaaaatacacaaaccttgtccaaagagacaatcaatgatttttatgctcaattaaaatattacacaccggaagccccgacagtaaaaaaggaattgcatccggattttataatagaaaaaggaatgcaagagaatctgatacactgtattctacatgcgagacgcctgttaactttagaagagggacttagatggcaagatataaagcgctatggcattgtaatctaccgccgctattatgaaggttataccttggtgaatatcaccgacaagatggacacgaatgaccccagacgtgcaattcagctaccggccagtgtcattacggcaggtatgcaaccaaatccaagaaatgactaactaacttaaggagggaaaaatatgaagaaatacatcatatatagtttaatcataacattaacctgcggactgggagcttgcaacaacgacgagggcgtggacaaagcaaacagcatcttctctacagaagaagtagaacgcagcccattcgacaactggatattgggtaattacacccatccgtacaacattgcattgaaatatcgcatggaagataacgagagcgatatgacacatgtattagctcctgccgactataaaaaatccgtagtactggctaaaattatcaaacatgtatggctggaagcatacgatgaagcgaccggtaatccggacttcttacgtcaatacatccccaagaccattcactttatcggctctcctgcctatgaagacaatggcaccatggtattgggaacggcagaaggtggtatgaaaattacattatacaatgtaaatgacatcaatcctgataaaatagatatcaatctgctaaacgaatactatttccagacaatgcatcatgagttcgcccacatcctgcatcaaaccaaaaactatgatccggcatttgatcgtatcacagaaaatgcctatatcggcagcgactggtatatggtgggagctaaccgcaatgcatggcaacaaggatttgtcacttcctacgcaatgagtgaatcacgtgaagattttgtggaaaacatcgcagtgtatgtcacaaataccaaagactactggaataacatgctgcagaatgccggtgaaaacggccgtgcactcataaagcaaaaattcgaaatagtctatagttacatggaacaaacctggggaatcaatctggacgaattacgcgacatcgttctacgccgccaagatgatatagcaaacggcaatgtagacttaagtattattgaataaactatgaaaattatgaagaaatatctatcaatatacacacttctggcattgatttgcattgtattacaatcttgtcttttctctgaagaagaaatattcgacgaatcatccgccaacagagctacagccgatgtaataaaatgtcaggagattcttaaagatgttccgaacggatggaaactggaatattacataggaagcaactattctgcaggtgcagtcaccctactaatgaaatttgatggaaaacaggtagaaatggcgtcggaagcaggagcagaaggttacaagccgggtaccataataacctccctgtatcaagttaaatcggaacaaagcactatgctcactttcgactcatacaaccagctgatccacatgttttcaggtcctttaggcctgaacatgaacgtgggaggagattatgagtttattatcatgagcgcaactcccgacaaggttattctacaaggaaaaaaatataaaaatataatggaaatgacgcctatgcccaaagatataccatggcgtatccagcttgaggatatcattaacatcgagaaagatgcttttctgaatacatatcgcatggagaaagggggccaagtactgaactactttatacgtgacaatggcacaatgtctacattctccgtttacagtaccgattatagcagtgcagaaagtttaccatatatttatacagaaaaagggctgaagttacagtctccatataatgtcaacggagttgaagtccagcacttcaaatgggataaaaagttcaggctatttgtttgtaccgatgcagatgcaacggatattgtattaaaagagtattatcccgaaaactatctgcaatatgaagactatatcggtacctacactgcaacggttgacgattacgatgaaggtccaacttcacaatctgtaaccatcactcctaaagtcagaggagaaagttatactctgaaaagtattggcggattcaacttcactcttctgtatgacaaagccagcggaaaactgatcttagattcacaaagtataagtccggtttcttcatcgtcttactactttgcgtgtgcggcaggtgtagaaggatatgctcacacagaattaagtttgccttcacgcttacgcagcggattagtaaatgttacggtgaaaatcaatcctttcactttctacttcgcggataaagcaagccaagaaaatacgtcattgataatctgggcttattcatccgatgaatattcaacttcaggactaatgggttactggagttggtataactcaatcttaatggaaaaagaaaacgaaggtaattaatacaattatgagaaagctttttaatatattcttatttgtactttgcaccatagcaatagcgggatgcaatgatacggaaagcagcgaatccaggttagagatcaaagctgtaaatactaatttccaagcgactggaggaaaaggctacatacaacttcaggcaacaggcaatataacagcagatgttaatgccgactggtgtgtgctgaaagaagtaaaccccaatgaagtagtattcgaagtaaaagaaaacaccggatactctggtagaaatgctttattgacaatcagtaacggagtagaaaaaaaggcgttcaatatcaatcaatccggagctgttttcatcttcggtaaagacgagtggatgctccgcaccgacaataaagcagctacgctacctataaaattacaaagttctttcgattatacaatagacatacccgcagaagctcaagaatggttgtcatttgaacagaatgcgaagggaataaatttcaaggtaaaagaaaatacctccggaaaaatgagaggagctattgtcaatgtggcagcaaaagacagatcggcttcttatcaggtaatacaatatgatgttgacgaacttaccggaacatggcaaggcatgttttcagacgggcaaatgaattacggcttgaaagatgtcatcattgaaaaacaggaagacggaacatacctgctttcaaacattctaaccggattgccttacaaactgaaagcaaaagccatagacaattgcctggcttttggggccggtcaaaacctaggagtcttcgaggacaatttatatctctcattcgaaattcttagctctgacctatattatgtaaaagatccttctgtaacaatctcattaggccccgtaatgttaacagacggaacattcgttttcgctttttccggaataaaagagagtgatcctttcggttttgttttccgggtatatgaagatgcaaaactacagaaggttatagacaatctgtccatttttattaattgtattctatttaaagaagacataatccaataacatatgaaaaagatactattaactagctttatcgtggcattaggattacttggtgcaagctgtaaagatgacaacagcaccgcaggcggaggaggagaaatacttccagaccaacaggtaagctgtgagatatttatgccgactaacggagaaaccgttataatatcagacaaactgattatcagaggagaaggaacgactaactatggtaaaattatctccgctgaacttaaagtaggaggagaagttattaccgacataagttcggttccattctattatgaatatactttccccaaggaagctgaaccaggagagttgaaaattgaattagcagtcaaaggagatcatgaaggcagtgctttggcaactattactgtcacaacagaactcggtgacaggcctgcaccacctcaatatggagaagacctcacagatacacgtgatggaaatgtatacaagacgatacaacttgcagaacaaatctggatggcagagaatttacgttatttaccggaacagaattttgatatatcttcaacagcgcccaaatattatgttatgttcgacagtgatatcaaaacagacttgggaaaagcttatttaaaagcttatggagcctactataacttacctgcagcacttcaaggtgaaacagcattaggagaagatgaaacacggaatataaaaggtgtttgtcctgacggatggcatattccttcacaaaaagaatggcagacattatctaaatatgttttagactccggcatggccgctatcatgaatgatggtcaggtagacgaaacagcaatagcaaaagctttagcttcaacaacaatgtggatgctgccggaatatacagaaatagaacctcaaccaacttgggttggcgtagaaatggaaaagaataatgcaaccttattcaacggtctacccatcggattccgtgcatgtgcaggtgacgaagactggatgcattcctgctacagtgccggctggtggagttcgacagctggagtacaaatgggacctgaattcggtatcaccgtacgtttatggtcagacctccacacatttgtaaccaatgcagaattcaatccgggagtaggtcttcctgtccgttgcatcaaagattaacgattatattattactcactaaatataaatacatttatgaaaaaatttggattctttttattcgcagtcttaggactaattgcttgtggtgacgacaacaatgatcccgctccagaacaacatgtaacatgctccatatctgcacctgctgaaggagctacggtaaacattgcagaaaaaatgacaatcaaaggagaagctacaattgactttggtgaaatctcaaacgtcacattaaaagtaggaggcaaagctatatcagaagttaccgcagtgccttttagctatgattatacatttgaagctaaccaaaccgaaggagcattaaaaattgaattaactgtcaaaggtgatcaaggaacaatggctacaagcgaagttaacatcactctgacaaagccggaacccactcctgaaccaggcgaaggagaaatggttgattcacgtgacaaccatgtatacaaaaccgtagaaatcggtgagcagacatggatggctgaaaatctagcttatttacctaaagtaaataaacctgctgctgccgctacttgcgaaggagaacctctttatttcgtttatgactacgatggtgaagatgtaaatgccgcaaaaaatactgaaacatacaaaacatatggagttctatataattggtatgctgcaatgaataaagaaaatgaagaagggaaggacgcagatgctgtaccaagtggagtacaaggaatctgtccaagtggatggcacctacctagtaaagcagagtggaaaatattagaaaattttgtagctgaacaattaccccctgttgaaggagatgtatgggaagatgattttggagacaaacactctgatccaaattgcaagaatgtttggtcagcattagcaggtcttgaaggatggagtgcttccggaaactccgacatgaaccctgacttggcaaatggacctcgtaatacttacggacttacaattattccttccgggcaatgctatcaaacaggaagctttggctggtcagaaagtggtgctgacttctggaccacagaaatgcaaagccaaggagcaggaaatattacttttagtaataatagctatggaataacttattctaaatatggaataacccccaaacgtggttttcctatacgctgtataaaagactaatttaataatataaatctctcttaagtatacatagaggtgtgtcgggatgacatgcctctttttctgtttataaataatcaagcaatatttctctatcgacttaatacttcacagaaaagcaaatcaaaaaataaatagaccttgacaacaaactaaccaaaaatttgtttactttgtatcctatcaatgattgaactactaataaattccatataatatggcaaaaaagaaagaaaagaaagagaaaaaggccggcaaaagaatgagtaagaaagagctggcagcattattaatagactttttccatgccaaatccagcgagaccttgagtatgaaatatatattttcggaattgcgtctcactacccatccgcaaaaaatgttatgcgtcgatatattacatgaccttttagctgacgattatatttctgaaatagaaaaaggaaaattccgtctcaccaatcatggaacagagatggtaggcactttccaacggaaaagcaatggcaagaattcctttattcctgaaggaggaggcgagccgatatttgtggccgaacgcaattcggcacatgccatgaacaatgacaaagtaaagatcaccttctatgccaaacggaaaaacagagaggcagaaggagaagtgatagaaatactggagcgtgcaaacgatactttcgtcggcacactggaagtagctaagtcatacgcatttctggtgacagagaatcgtacattagccaatgatatcttcatcccgaaagataagctgaaaggcggaaagaccggagataaagccattgtgaaagtaaccgaatggccggacaaggcaaagaatcctatcggacaagtaatagatatattaggtcaggctggcgacaataccacagagatgcacgcaattcttgcggagttcggtctgccgtatgtatatccgaaagcagtagagacagcagcggataagattcctgccgaaatttcagcagaagagattgccaaacgcgaagattttcgtaaagtaacaactttcaccatcgacccgaaagacgccaaagattttgacgacgcactttccatccgcaagctaaaggacggattgtgggaagtaggtgtacacattgccgacgtgacacattacgtaaaagaaggcagcatcatcgacaaggaagcagaaaagcgggcaacttccgtttatctggtagaccgtaccatcccgatgcttcccgaacggctgtgtaacttcatttgttcactccgcccgaacgaagaaaaactagctttctccgttatcttcgatattacggaaaaaggagaagtcagagactcacgcatcgtacatacggttatcaactccgaccgtcgcttcacctacgaggaggcacaacaaatcatagaaacaaaagaaggagacttcaaagaagaagtactcacgttagatacgattgccaaagcactgcgcgaaaaacgcttctctgcaggagccatcaacttcgaccgctacgaagtgaagttcgaaattgacgaaaaaggaaaaccaatcagcgtttacttcaaagagtcaaaagatgccaataaactggtggaagaattcatgttgctcgctaacaagaccgtagcagaaaagataggatgtgtgccgaagaacaagaaagccaaagtgcttccttaccgtatccacgacctgcccgatccggagaagttggagaacttgtcacagttcatcgcccgcttcggctacaaagtgcgtacaagcggaacgaagactgatatttcaaaatccatcaaccatttattggacgacatacacggaaagaaagaagagaacctgatagaaaccgtatccatccgcgccatgcaaaaagcacgttactcaacccataacatcggtcactacggactagctttcgaatattacactcactttacttctcccatccgccgtttcccggacatgatggtacaccgtttggtgacgaagtatatggacggaggacgcagcgtatccgaagctaagtacgaagacctctgcgaccacagctcgaacatggaacaaattgcagccaatgccgagcgtgcttccatcaaatataaacaggtggaatttatgagtgaacgtctggggcagatttacgacggtgtaatctccggcgtaaccgagtggggactttatgtagaactgaacgaaaacaaatgtgaaggtctggtccctgttcgtgatctggatgatgactactacgaattcgacgagaagaactattgtcttcgcggacgccgcaaaaacaaaatatacagtttgggagacgctattactgttcgggtagctcgtgccaatctggaaaagaaacaattggattttgaattaatagaaaagtaaattcaccacagagtacgctaagaaatcaggaagtaaaaagacttcgtgtactccgtgtcctctgtggtaagccaaacagccattatgaaaactgtcattattgaagataaacaacgaatcgaatccattattctccactgcgatgcctgttttgtaggcattactgatttggaaggtaatccctacgtagttccgatgaacttcggttatgagaatggcatcatatatcttcattcgggtcctgaaggcagcaagttggagatgctggaacataataataatgtatgcatcactttcagcgttggacataaacttgtctaccaacacgaaaaggtagcctgcagttacagtatgcgttcggaaagcgcgatgtgtcgagggcaagtagaattcatcgaagagatagacgagaaacgccgtgcattggatattatcatgcgtcattacacggatagtgagttcaactattccgatcctgcggtacgtaatgtcaaagtatggcaagtacgtatcaatcagatgacaggaaaagttttcggtctgcgggccaacgaaaagccatgaagcggttttccggctttcgacaatacttgagtagagtattcaacaagcattgtagagtatttccaaactaatttctctaaacaaaagtttagatcacttttaccctcacacccccaccattgcctgtatctctttatccatcgacattacaggtgtgagagtaaaggtgattataaagactattctatcctctcatatcaaattctttttgtatacttgcaacataaataaaatagataagtactcttgcaaaaaaatagattatgaagaaactgctatgtctcgccctgttagtatctgccggaagtatctactccggaagtatctcggcaaacaacaaacctactgataacaaatccggcaacaactcaaaggacatatacaaaaagacctggatcgacttcaataaaaacggtataaaggatgtatacgaagatccctccgctcctatcgaagcccgcatcgcggatttgctttcgcaaatgacgctggaagagaaaacctgtcagatggctactctctacggttcgggacgggtattgaaagatgcatggcctactgccggatggtcagcggaaatttggaaggacggtataggaaatattgatgagcaggcgaacggactgggtaaattcggttctgaaatctcctatccgtatgccaacagcgtaaagaaccgacacaccattcaacgctggtttgtagaacagacacgactgggtattccggtagacttcaccaatgaaggaatacgcggattatgtcacgaccgggctaccatgtttcccgctcaatgcgggcaaggtgccacgtggaacaaaaaactgatccgggaaattgcgaaagtcactgcaaatgaggcaaaagcattgggatataccaatatttattctcctattctggatattgcacaagatcctcgctggggacgtgtggtagaaagttacggagaagatccgtatctggcgggcgaattgggaaaacagatgatcctcggtctgcaaagcgaaggtattgttgctactcccaagcatttcgccgtgtatagcatcccggtcggtggacgcgacggaggtacgcgtacggatccgcacgtggccccgcgtgagatgaagactctttatctggaacctttccgcaaaggtattcaggaagcgggtgctctaggagtgatgagttcgtataatgattatgacggggagccagtttccggaagttatcatttcctcacggagattttgcgtcaacaatggggattcaagggatatgtagtatcggatagtgaggcggtagagtttctgcacaccaaacatcgtatcaccccgactgaagaagagatggcagcacaagtggtcaatgcaggattgaatatccgtactaactttactccgccacaagattttattctcccgttgcgccgtgctatcaacgaaggcaaagtttctttgcacacgctcgatcaacgtgtcggtgaaattctccgtgtcaagtttatgatgggactttttgataatccgtatcccggtgatgaccgtcgtccggagacagtggtacacaacgacgctcataaagcagtatctatgaaagccgctttagagtccatcgttcttttgaagaatgagaatcagatgcttccgttatccaagaacttcagcaaaatagctgtgattggtccaaatggggaagaagtgaaggagttgacttgcagatatggtcccgccaatgcgtctattaagactgtatatcagggaatcaaagaatatctgcctaactcggaagttcgctatgctaaaggctgtgacattattgataaatatttcccggagagcgaactgtacaatgttccattagatacacaagagcaggcgatgattcaggaagcggtagaattagcaaaggcttcggatgtcgctatccttgtactgggtggaaatgagaaaacggttcgggaagagttttcacgtaccaatcttgacctctgcggacggcaacaacaattattggaagcggtttatgcaacaggtaaacctgtcgttctagtgatggtggacggaagggcagcaaccatcaactgggcaaacaaatacgttcctgccattatccatgcctggttccccggagaatttatgggggatgccatcgctaaagttcttttcggagactataatccgggaggacgtctggctgtcactttcccgaaatcagtgggacagattccttttgcattcccattcaagccgggctctgactccaaaggaaaagtccgtgtagacggtgtactttatcctttcggatatggtttaagctatacgaccttcggatattcagacttgaaaatatctaaacctgtgatcggtccgcaggaaaatatcactctttcatgtactgtaaagaatacaggaaagaaagcaggggatgaagtagtccagctttatatccgggatgatttcagcagcgttaccacctacgataaagtattgcgtggttttgaacgtattcacttacaaccgggagaagaacaaacggtcaactttacccttacgcctcaagacttgggattatgggacaagaataatcagtttacagtagagccgggaagtttctcggttatggtgggagcttcttcacaggacatacggctgaaggggagttttgaggtccaataaataaatccaagacagtcactaaaagcaatgtgaggcagcctcttactatttaggccacctcacattctttttatttctctttcgtcaactaggatagagttataagttatacttaataacacaaataaaactggcatctttataagttatgcttaataaaactgccatatctgttttgtatatcaactataactataaaaagatgaaacttatcaatagccctatttatacagagcgtattcgtcggttcactgtaaaaggggaggatgtcaaccaaagatattgcgcaattcaccaatcttactattcgtggagtagaaacagcccgttaccgaataagaaagaaacttgccattcccggaaatataaatcttgttgatttcctgattgactttacataggaacatttactgaatattccttctaatttcacacccctattctgttgggattttctaaagaaactttatctttgtaatgtcaacaattaaaagaatatggttcgttttaatcttgttatcaccttactactaatgataagcatagctgtcaaagccgaactgaccaaccggatgttcgatgtcaggcatgtaggctatgcagaaggccttagtagtcaacgtgtcttttcgattgtcgaggatggagacggtgctatgtggattgctacaaaaaccggaatagacagatacaacggtcatacggtaaagaactatgatttgccgggcagtttctattatggcgatcttgccggacgcaggctttacttattgtacgacgcacaacaaggactgttcgcctacgaccacaccggacgaatctaccgatattccaccatcctggatcattttgaacaagtcctccacctgggacaattgattcaggaagaagtcatcttgaacaaactctgtttggatagtgacggaacctggtggatgggggcggataaaggactatacaagcaagaagcggaccatcgtatagttgccgtgttgaaaggacaatatgtcaacgacattgcatttgccggcgagtcgctttttgtgggcacttctaacggagtctggcaactgtcacacgccctgccggataagaaacgccagctgctggaagggtggaatgtacaaacattgttctgcgacaaaccgaaaaaagaactctggataggcacatttggcagcggtttgtctgtgatgaacctcgacacttccaaagtgcttgcgctggagggacaagggagcacgttccttcatccgatacgggcaattacagactatgatgtgcataccatactcataggcgtggacggtggcggtgtgtatgcgatagacaaagacaccaagaaagcccatttactgatgaataccaaagatgacacagatacttacctgcgcggaaacggcgtatatgccgtaaccagagacgaccaaggcaacatctggataggtagttatacgggaggcgtatccgtggctatcctgctgaaacatcccatttcgatattagcacacgaaaaaggaaatacccattctctcatcagcaacaacgtaaatgatatcgaagaaaacccggatggcaaccaatggttcgctaccgatgatggaatcagcatccgaaacaccctgtcaggcacttggaaacacgtgctgaaagaaatcgtaaccatttctctttgcacatccggaaatgggaacgtatgggtaggaacgtacggagacggagtgtatctattggataacaacggacgcgtgttacgccatctcaccaagcaacaagggcaattgaccaccaattatattttctccgtcagacaagacatggagggagacttatggataggaggtctggacggatgcctgatcatgtttgaaaaagaaaaaggcagcagacagtctttcgacgtgaattgggtacagtccattgaacctatcgaccgaaaccgggtagcggtggctaccgtcaacggttttttcctagtggacaaacatacagggaatatacagcactatgccaattcccaggaatttcacaatcagaatgtcagtgcttatatcatctctatgctgttcaatgacgacggaaccgtgtggctgggaaccgaagggggaggattgaatctatatgatatgaaaaaccggacggtaaagactttcactgttcaagagggattgccgtccaacgatatatatagtttgcagcgagacgacaagaaacgcttgtgggtcagcaccggaaaaggaattgccttgatagacagcctgcgcgtgtcgaacctcaactatgcgggcaatatagacaaggaatataacaaatcctcatttgcccggttgatgaacggcgagtttgtgtatggcagcacggatggcgctgtctttatcatgccactcgacatttcaaccgtagactactggacgctcctgcgtttcacgggactgacggttgattatcaaaacgtccaggaagaagaatcgttgaaacctgccatccatgatatgcttgccgaccgtgcggtacggctcggctataaatacaactcgtttaccgtttcttttgaatctatcaactatcgtttccagcgcgatattgtctatcagcatattttagaggggtatgacaatgactggagcaaaccgtctgccgaggggaaggcatcctacaccaaggtatcgccgggcacttatctttttaaagtgcgcagcctgcgacgcagcgacggaaagactatctccgaaagcaccttagaagtgaaagtgagccagccatggtggaactcgtggtgggcttggactatttacctatttataataggcttcgttttctatttcatcctgcgctataagagcaaccagctccaaaagaaatacgacgaagacaaaatacgtttcttcatcgacacggcacacgacattcgcacaccggtaacgcttatcatggcacctctggaggatttgaaccgggaacaggatctctcggacaaagcccgttattacctgaatctggcccatgaaagtacccggaaacttcattcgctcatcacacagttgctcgaatttgaaaaggtagacgcccacaaaccatcctcttcatcggttccgctttgtctgaatgaagttttgctgaaagaagtctccgtcttccggtctttttgcgagaagaagcagttgacactgaatctgacccaacccgacgaatccattttcgtttcggccgacaaacacctgatagagatgttactcgacaatcttctttccaatgcctgcaaatacaccatgccccaaggagaaatcagcctggatttgaaagccacaaaacgcaaagccatcctttcgttgaaagataacggaataggcataccgaagaaagcgaagaagcatatcttctccgatatttacagagccgagaatgcccggcagtcacaggaagaaggaaccggattcggactgttgcaggtgcaacgcattgtaaagatgctgcatggaaaaatcactttctgttccgaggagagcaagggaactactttcatcgtaacattgccgcgaaccaccaccgtagccaaacccgtgtcgcacgaatcatccctcgaacaccttgccggcacatcggataataacagccacgaaacggacaaaatgaaagatccggacgaccggaatacattgctcattgtagaagaccacgaaactctccgtcactacctccgccagacctttgaacacctctatcgggtgattgatgttgccgacggacacgaagctatcgcctgtctcgccaatgaatatccggacatcatcctctccgacgtcatgatgcccggcatacggggtgacgagctttgcagaatggtcaaggaaaatcctgacacatcgggtattcccgtcgttctgctgacggcaaaggctaaccacgaagcaatagtggaaggattgaagaaaggcgcggatgattacatccccaaaccattcagtacagagatactgaaattgaaagtacaaggattgattgacaatcgaaacaggcaacggcagtttttcatgcggcaagccatcgctcaagtagaggcgggcggcaaacgtgacgacaatgaaagcaatgaaagtatcgacaacaaaaacgtaacgacagcaagcgaaacaatggccgagggcgaccgccggtttatcatgcaagctacccggtttgttcttgaacatttggatgaacccgatttcaacatcaatctcttgtgccatgaaatggcaatgagccggacactattctacagtcgccttaaatcactgacgggaaaagggccgcaagagtttatccgtatcatccggctacaaaaagctgccgaactgctgaaagaaggtaaaagcgtaaccgatgtcgccgccgaaaccggattcgtcaacacgaagtatttcagttcattgttcaagaaacaattcgggatgcagccaagtaaatatagtgggaagtagacaagcattcatgttcggttttgaattaaaattagctcgtttccggtacagtaatgaactgtttcagcctattctgacaagggtatattctcactgcaatgagaaaaagttctcattataatgagtatttcttctcatacctatgagtattttttctcatagtgataagtatacttgagaatgtttacggaagtttttttgaattataattgtatgagtttacctcatttccgtaccgttcttaattaaatgggaatttatcggttaaatgggaatttagcagttaggctgaaagccttacaattatatatttattggggtgccctgaaagggcttaattatatagcgtagggcaacgccctacgaaaaaaacacaccagccacaagccctgaaagggcggaactgtatacaattatgccctttcagggcgcaaattcagattgtcgtttttacgtagggcgttgccctacgctatgtaattaagccctttcagggcactccgcaaaattatcatttacctcattcttgtatagcaacaaccttcgaaaaagaatggataagataacgtccgttcgataaaaatcagcagatttgtcagcaatcaaacctaatatgtcagcaatctgaccatcgtttcagccggatattagcatctttgcaccaagctttacaagtataaagcacatattacgtttaacctttaaaatgctaaaacgatgaaaaaagtagcactattcctatttttatccgtttgcttcgcgcaacaatcctgttcgtcggattctgttggaacggaaccggaggaaaatccacaagacattctttttaaagacgatttcaactttttcgacgaaaaagtatggacgaaagaaactcatgaacccggttggaccaatcaagagctacaggcatacgatgccgctcatgtatcgataggaaaggacggggataaatcggttctgattcttaccgccgaacgcaaagggaataaaatttactccggcaggatcaattcaaaagggaaaaagagtttcaagtatcgcaagatagaagcaagtatcaagcttcccaagactaacggcggactgtggcctgcgttttggatgatgggagataacgacaaagaatggccggcatgcggggagatcgacattatggaaatgggagaacagagcggaatggctgcgggcgattcggaaaaacaagtgaacaccgccattcactatggccctagcgcagcggctcacgaacagcaatactacaaagccaatgttgccaacagcctgcaagacggcaattatcacacctactctctggattgggatgaaaacaacctgacaatatccatcgacaacgtcaagtttcatacgttcgacattagctcgaacacatactttcatgacaacttctacatcctgttcaacctcgccgtgggaggtgcgtttacagggattaccgacattaataaactgacgggcctgaaagacggtcagaaagtgaatatgtacatcgactgggtgaaaatattataggaatcttaaatatatatgctatgaatatggaaaaatgtaagtatctactgttttgcggaacactcgccctttggatggcgggaggtttccagcaagtgtatgcagcaacggaaccaagttcccaggctattcaacaacaaagcaacaaggtaaccggaaaagtgagcgatgccacaggtcccatcattggggcttccgtagtggagaaaggaactgccaacggaacgattaccgatctggatggaaatttcagtttgaatgtaaaagcgggagctacgctcgttgtcagctacgtgggttataaatccgaagaagtaaaagcgggaagaggtcctttgaacatcaccttgaaagaggatgccaaagcattggatgaagtggtagttaccgcccttggcatcaagagagagcgcaaagcgttgggctatggcattgatgaagtgaaaggtgaagccttgaccaaagcgaaagaaacgaatcttatcaactccatggcaggacgtgtgccgggcttggtagtcagccagaccgccggtggtccttccggttctacgcgcgttattctacgaggcagtaccgaaatgaccggcaataaccagcctctttatgtagtggacggtgtacctttggacaacaccaatttcggcagtgccggcacaaacggaggcttcgacttgggcgacggtatttcgagcatcaatgccgatgacgtagaaaacatgtcggtattgaaaggccctgcggcatccgcactttatggtagccgtgccagccacggtgttatcttgattacaaccaagcgagccaacaaggataaaatcagcgtggaatataacggaacactgactttcgatacccaacttgccaaatgggacgaagtgcaacagatatacggtatgggaagcaacggtacttatagctatgatgccatatccaacacaaacaaaagttggggtcccaaagcggacggttcaaacatgctgaagtatttcgacggcgtggaacgccctttcctcattgtccccgacaatacgtccaacttcttccgcacgggtatcaccgccaccaactccgccatcataggtgtgaacagcggaaaaaccggaattcgctttacctatacggatatgcgcaataaagacattgttccccaaactcacatgagccgtgacattttcaacctgcgcgccaatacgtctgcaggaaaggtagacctggatttcagcgtcaactatacacgggaagacgtgaagaaccgtccggcactgggcgacagcaagtccaatatcggtaaaaacctgatgacccttgccaccacctacgaccaggaatggttgcaaacctatcagactgccgacggcgaatactccaactggaacggtatggatccctacaacgtgaatccgtattgggatatctataagaacttcaataaatccaaaaaagacttgttccgcatgaacggcaaggccgtatggaacatcgacccacatctgaaacttcaggcaacgttgggcgccgaactcaattggttcacgttcgatgattataaagcacctaccactcccggattcgaagccggaagacttcaaaacagcgctttccgcaaccgcatgtacaactttgaagtgttggctctctacaacaaccattggggtgatttcgatttcaacgctacgttaggtggcaatgtatataaggtgaacaaccagaccaccgttaccaccgctcaagacatgaagatacgcgatgtcccttcattgacgagtttcaacgagatcagtgtagtgcccggcagttaccgcaagcagattaattcggtttacggagcagtgaacgtgggctggaaacacatgctttacctcgatgctacgttgcgtggcgaccaatcgtctacccttcccactggcaacaacatgtatatgtatccttctttctccggcagctttgtattctccgagctgacaaaactgggcgacctcctgccttacggaaagttacgtatgtcatgggcgcaagtgggtagcgataccgatccttatcaattgggactcgtctatacgaaatccaaatatgcttatcccggatataccatcggatatatcgataacggaaccatccccaacaaagacttgaaaccaaccaaaacaaactccgtggaaatgggattggaattgaaattcctgaagaaccgtatcggactggatttcacctactattctcaaatcagtaaaaaccagattatgggaatggcaagttcctggacaaccggttacaactatcgcttgattaatgccggcaagatagaaaacaaaggtattgagattgcccttagcacacgaccgattcaaacacgcgatttttcctgggacattaatctgaacttctccaaaaacagcaacaaagtaaaagaactggatggcgaatcagatatgtttgaactggaaaaggcgtcttggctcgacgttcaggtggccgctaaggtaggcgagaactttggttctattgtaggcccggacttccaacggaacgaaaagggagatattctgattgacccgcaaaccggtctgccgcaatatgacaagagcaaccacgtattgggtaatgcctcttgggactggacaggtggattactcaccaactttacctacaagaatctttcgctggtagcggtattcgatgtgaaagtaggtgccgacctctattctatgtctgcccgtgctgcttacgaatcgggtaaaagtccggagacattggcaggacgcgacgcctggtatcgctcggaagaagaaagattggcagccggcattgcaaaaggagccgataactggaagccgacaggcggattcgttgctccgggtgtcatcgacaacggtgatggaacgtatcgccccaacgacatctacatcaatccggaagactactggatgagcgtttgccgtaatgcaccttctatgtttatttacgacaactcatacgtgaaatgccgtgaactaacgttgagttacaatgtgcccaaatcctggctgaagaatgtagtaagcggactgaccgtttcgttcgttgcccgcaatccgttcatcgtatggaagaatatcccgaatatcgacccggattccaactacaacaataccaccggtatgggacttgaatacggttcgttgccttcacgcagaagctatggttttaatgtaaatgtgaaattctaaaaagatatatcatgaaacaatctaaatacatcacaatcatcacgatggcatgtgccctgtttttcgcttcttgcagcgatgaatacatggaaaacatgaataccgacccttccaaggccgctaccatcgacccgaatgcgcagctcaccactgcccaactgcaaacgtacggagaccttagtatgatggaaatctaccgtaactaccattatgcattcacccaacaactgatgggatgttggaacaccaccaactacggcggacgccatacgctagacaataatgaaatgagccgtatctggacatcgttctacactcaatccctgaagaatatcattgatgctcaatatcgcacagccgaagatgcagagaaagtgaacatcaactctgtgctccgcatttatcgggtttatcttatgtctatcatcaccgacacttacggagacgctcctttcagtgaagccggcctgggattcctcgaaggaaagttcaatccgaagtatgacaaacaggaagatatttacaacgctttctttctggagctggaagatgccgtcaataaaatcgatccgaccaaagataaagtgacaggtgacctcatctatgccggtgatgtaactaaatggcaacaactggcaaactcgcttcgcctacgttttgccatgcgaatctccaatgtcaatcctacaaaggcacaaacggaatttgaaaatgctttggctgccaatgggggtgtgataacggacgcctcaagcgatgcactcatcaaatacatgacaatcgcatttagtttcggacaagaagcttactctgattatcgcggaaattcattgtcacagttgttgttcggcaacgaccccgctaataatccaagttacctctgctccactttctttaatcagttatacaattccggtgaccctcgtacattcaaaatttcccgttgttattatgacgggctgatgagtgccaccagtcccgacaatcgtgtcgacatcacccaggagatgattgaaaaagggattgatttcagtccgcgcgacccgggtgcctactcgtgggaaccatggcctacaggatacgacagcgatatttgtgcggaattagccgttaacaacccttccgttacagcaaccatggctcgtgaagtggaacccaaacttgccaataatttcctaaaaagcgacaatccgggcgtagtgatgacctctgcagaagtgaagttcctgatggcagaagctactgtgaaaaaatggaatgtcggcagtgtgtcagcagaagatctttacaagcaaggagtacgtgctgctatggatttcctgacagacaactacggttgcacggctactactgatgcagagtttgatgcattcattcaagataaaggggcgttcggacatacggacaatcagaaacttgaagctatcaatacacaggcctggattcttcacttcaccaatcctgccgaatgttgggcaaacgtacgtcgttccggttatccgaagttgaaatcaccggcagaatatgggttcggacaatacctcaccggtggaacggaaattccggtacgtctctgctatcctgtattggaatcttcctataataaaaagagctacaatgaagccatcgagcgcatgggaggaacagacaattggcacagccttctgtggtgggatactgaaaactaactattaaacaatcatccattatgaaaaagatatatattgcactatttgccctactcgctgtaggctccacatttactgcatgcaccgaggaagaaccgttcgctacggtgacagaaaatgatgatccgcatatccttgccccggtatttcctgacagaacgaacggtcaattggctacattcgccaacatcagccgggatgcgaacttatccatcgcgctgaccgtgactccgaaagattacaccacagtaacctggttcattgatgggcaagaagtaaaatcgggtaccgactccgacaaagaaatcaaccgtagtctgaaagccggtacgtataatttgaaaatagaagtggaaactgtgaaagggaagaagacttcccgtgaaggattggtggtggtcaatccgttggctgatgaccctcaatctaaagaagtagcctttgagagaattgtatctcccggtaagactgcccgtttatatggcagtaatttacagaacgtaacagccatcctcttgggaggaaacacgatcaccgatcctacttatgttgaatcggcagacgagaattatctggaatacatcgttccgacaggcgtaagcgaaggcgattaccgtatcgttctgcaagatgccgacggcaatcaatatggagccgacatggtgaaagtgactaatgcttcccttgtcatttcgggtgctaaccgggctactgccaacgtggactggaccatttccggtatcaatcttgaaaacatcgcttctctaactatcggcggacagacggtgtctcaattcagcaatcaatcttctacggaagttacgctgacttgtccggatttgtctgatggaagctatacgctgacaggcaaaacccgtagcggagaggctgtgcagttcttgaacgataatattacgactaccgaacagactgtgaccgtatctaccgaaataacactttggtcaggacaccattacgtttcgtgggataagccggacggtgatcccaacaaaacttttggtttgattccaatggatgtatttgccggtatcacagccgggtcgacattgaaagtagtctactccatagaacctactgccgaatatcataagatgcagcttgccacaggctattggacaggcttggcaggtgagatggaatttacggaaaacggtgaatatacactgatactgacacaagacatgttgaataagattcaagctgaagccggattcttatgtgtaggacatggctattatgtagacctggtaaccgtgaaataatgttcctaagtaagtttaaaaatcattcataccataagtatctgtcattcttcgggttaaagtcctctgaatgacagattacataaacgatgctacttaaaaacaaatcataatgaaactaagaaatattatattaatgaccgcatctgtcgcaatgactgcctgttccaaacaggcagttcccactgccattcctgaagacgcaaaaatagaacaacaagtggaagagcttctatcaaagatggacctcgatgccaagattgggcagatgaccgagcttgccattgatgtattaggagagacgataaatggtgaatttcaattggacgaggcaaaactccacaaagcgattgctgaatacaaggtaggttcgtttctaaatgctcccggcccggtagcacaaagccctgaaaagtggaacgagattatcggtcgaatacaagaactgtcgatggcggagattggtattccatgtatctacggtctggatcagaatcatggtactacctatacattgggcggcacgctctttcctcaaaatatcaatatgggtgctgccttcaatccggatttgacctacgaagcggcacgtgtaacggcttatgaaacaagggctagcaattgtccctggacatactcccccactgtcgatatggcacgtgatccccgttggccgcgtgtatgggaaaattatggagaagactgtttagtcaatgccattatgggcagcactgctgtccgaggcttccaaggagatgatcctaaccatattcccgccgaccgaatcgccacctccgtgaaacattacatgggatacagcatgccacgtaccggcaaggaccgcacaccggcttatatatctgtttccgaactgcgtgaaaaatgttttgcaccgttcaaggcttgtgtggaagcaggtgcactgactataatggtcaacagtggttccatcaacggaaagcctgtgcacgccgaccgcgaactccttacacaatggctgaaagaagacttaggatgggacggaatgttaatcaccgactgggcggacatcaacaatctttatacccgcgaacatgtggcagcaaacaagaaagaagccatcgaaatggcaatcaatgcaggtatagacatggctatggaaccgtatgatctcaattattgtacactactaaaagagttagtgcaagagaagaaaatacccatgagccgtattgacgatgccgtccgccgggtgcttagacttaaattccgtctgggtctgttcgatcatccgaacactttattgaaagattatcctctcttcggcagcaaggagcatgcacttatcgcacttcatgcagctgaagaatcggaagtattgctaaaaaataaagataatattcttccgcttcctcaagggaaaaagctactggtaaccggtccgaacgccaactctatgcgttgcttgaacggcggttggagctattcgtggcaaggacatctgaccgacagatttgctgacaaatataacaccatttacgaagcaatctgcaacaaattcggagccgatcatgtccgtctggaacagggcgtaacctacaaacccgaaggtgcttacatggaagaaaatgaaccggaaattgagaaagctgtggccgctgcccgcaacgtggatattattatcgcctgcatcggtgaaaattcatattgcgaaacacccggtaatctttccgaacttgccatctctgccaaccaaagcaaactggtaaaggcacttgccacgacaggtaaaccgatcatcctgatactcaatgagggtcgtccccgcattatcaatgagttggagccattggctgatgctattattgacattctattacccggaaactatggtggcaacgcattggcgaacattctggcaggagacgtgaaccccagtgccaagatgccttacacatatccgcgacacgaagcagcactgactacctacgattatcgggtgagtgaagagatggacaaaatggaaggagcttatgactacaatgcagtagtctccgttcaatggcctttcggatacggattgagttacaccactttcgagtacagcaacttccaaacggacaaatcttcgtttaccgcaggagatgatttgcacttttccatagatgtaaccaataccggtaaatatgccggaaaagaagttgtcatgctattcagcagtgatcttgtggcttcgcttactcccgaaaaccgccggttacgagccttcaaaaaggtggaactgcaaccgggcgaaacccagactatcactctatccatcaaaggcagcgacttggcttttgtcaattccgacgggcaatgggtactggaacaaggggatttccgtatgcaatgcggaaatcaaacactgaatattatatgcaagtaaacagaatacacgaattaatatcctccacttaaaaagcagaaacgatatggacaagcggacaagtatattcgtttgaatgggcaataaagagactgctccgtcatagaactaatttctgcattttagaaggtttcctcacagtgctacttggtgaaaatcatcgagatactcaaaagtaaaagtaatcagcaagtagccgatgataaattcaaccatgtagatatcaaagctaaaaacgataaggatgaaataatcatcatcgaggttcagaacactcgtgaactttactatctggaacgtattctctatggagtagcaaaagccatcagagaactgaaataaaatgaaggggatattttttatgtatggtggaaagttacagagatatgaagtggtagaattagccatgcaccgtgaagatttcaccctcacccccaagacttgggattatgagacaagaataatcagtttaccgtagaaacgggagtttcttaggcgtgatgggtgagagtttcttcgcagaatattcggctgaagggaagttttgaggttcagtgacctccttacatgttatatccctaccggatacaaaagatattctaccaatcgtccgttctgaatgaagaagcaggcaagccacactcactaaaaagagaagcctctacataatttctataagcgtaccttactgcaacaggtacgctgactttctcgctatgaactataacggacgaagattttgaacccactacagctttgcccggataaaacttccggtcactgcccgcaacttcaaaaccattcaattcttgtccgacaggtcctactccatacgccaagggtgtactaaatttcaagatggctctattctcccggactgtcatcgaacgatattcaggtcccgtatagcaagtatacttataaccgtaagttttggccaatgcataataagccaaacgttctcccacttctttctttttagccggatgaatgcagccttgttccccaatatcaagagtcaccaccatgcctgaatgaggtatttgggaggcacactttagctgtacctctcttaaagaagctccttcaatgccttccgatgaactatatgcaaaaggagctatctgtacatagtagaaaggaagttcgggtttctgaaatgtattacgaatatcctgtacaaaagcaggaaacaacctggcatattcttcaggcttattacgatttgcctctccctgataccaaatcatacctttcaccgccagattgcgaatgggataaatcattgcattatataaaagagaaggcgtttgatgaacaggacgtttggcaacagaaagtatatccaatgcccggaaactttcccggctcatccatgtttcaatattcgaaccattccaggcagaaatgacaatacccaccgggattcccaacacttcttgcaaatatttaccaaaaaaataggctgtagcactgcaattggccacagcacctgagtcatgacatttccactggcctccgctatgttccaaaggcactgcactggaatgattgcttactgtatatattcgaagcggcacttttttcttagcccgggttatgtaatcattcgcataggcaacaggctgtcccggaaatcctttcatcggcattcccatattagactgccccgagcataaccacacctcccctattaaaacatcttctaggattattttgtcaccatcatcgaacactatattatatggtccaccggcagaaggagtatagaccgccacttgccactcccctttttcatttacaactgttttatatgttttctgtccccatgaaggagtaattttaatgactgtccctgaagagccatgtccccacaattttattgagtcacattgctgcaataccatatgactggctataatatccggcaatacaactttagccgatagggaagttatagaaactgccattaaaaacaatactaagagttttctcatctatttaattaatttattccgaaaaataaaaagaaggagggctaccaaagttaaaaaatgcgccctccccgttattatcatctacctatcttataactgtaattccaaaatcgcagcatgaaagtcatctatcacttcctcgccaggcttataccaagtacaatatgtcactttccgggaaaggtcaatacctacaatttttgtcgcacttcccaattcttccgtaggcttacgaactgatgcttgctttccggacaaatccgtataaaacacttcaacgccgatctcttggtcactattacttcctccccactcgatagtcaattcattatctcctttcgtaagtttctttacgatacgattgttaagcgtcagctcatattgagctccatatactttcaacaactgttcatatctgatagagcggtgttctttatcgtcatgagtataaaacgtaaatgtataatctccttccgctatagaagacccattttcgccaatcattatatccaatccctctaaagggtcatgtgccggaatatcgaatacggccgactctttaccgtgattccacaatacttccagatgcttggctctgggatcggtcacccaataacgaatctttaccctttctctaccactgaagacatgaatagaatctactcttccgatatagacagtctccccatttttcagatatatatcatgtacatcgttcatatccgaacaggctgccagccagatcatgcacatacaagcaacaataaaatataattgtttcatactgttttttctttatttagtactaccccataatgatatctcgttgataaatgcaccatccgtatctccccaagtggtgtgtatctggaatttcagatagcgcactttcggcacatccacaggaaattcccattcttctcccgcaagcatatgttccttttcctcagcattcggttctcctcctattatctgcccggatggacggaacgattcacaatccatcaattttatccatccttcccagttatcgggatcttttgttactgccgcatcattcgtaccatacacggtaaaggtacgcaaatgatgcaatctatacatatactgcaaacgagtccacaatctaaaccgcgacagcttactttccacacccatatcaaaagagaagtaaggcttcattcctgtaccggcagaaatatagaacaaatccttttctacattatacacattgttccacatccccgtcattgacttgctaccgaagttgttatgagtaaaatacttacccaacgggaattccataaacttcgacttatccatttcttcctcaaaaagaggagtcatttctttatagagggtatcggtatgattatcataaatatcgcgaaaataaaaagcaaaatccgctggtttcgcatccaatccgcgaatagccttatctgccaccgcttccgatgaatagatagtctcgacgtgtttccaagttccatcactttccttcatcattgcccccaaaacgacattctcttttaatggattttcccaatgtaattttacgcctccgaatgcatcaaaaagttgcaatgtgtgaaaaacatcataaatcggagagtcttcaggctccacctctactacacaaggagccgactcattatagctcttatctattgaataaagttcaacctgatacttgcgtccctttccgaaaccttttaattcgattttgttcgaataagccgaactggacatctctcgcttcactccattttgcaacacataccgtgccgtaacacacaacaaatcatcttcttccggcaaagtgtaagtcaaaacaacccgccctttcatattttgcacctgcacatttgatacttgtttcggggccacgctatccaccggatattggccgatatattcctccttacaaccactaaacacagtgagaagaagcaatacaaataatgcattatatactgttttcatattttgccatattaattagtcccaatacggattttgtattagatttgaatttttcatcaattctgcttcacggataggccacaaatactgcttggtagtgaactgtaaaggctgaaccgtaatcacattataatattcctgttctgtgctctgatgtacattccatcctctttctacttgattatagtagatatgagccagtttccatctccttacatcccagaagcgcttgctttcgaaagataattcaatcattctctcctgacggataatgtctcgcatacctatctttgtaagaggcttatccggattcctggagtagttgctccaactctctttcactcccttcaagccggcacgcttacgtacctcatcaatataatagtatacttcatcattcggttcattcaacgactcattcaatgcctccgcataaagcagatataaatcggcaagccgcataagcggataagtagtacgtgcataagtagcttttccgttcgcatcagtagccgcctcgaaatgcaccatcttcttacaaaagtatcccgaacgggaataggtagtttctttggtctttccggacatttgtcctttttttgccgctacaatccacggagtctcggaagccgtcccttttcccacatcttttgtcctaccattgccaaaccagtaaccacgatcaaatcccaagtctgcatagaaacgaggttcacgataaaggttcaaataagcagttctctcaccttttttgatatagtaagtatggtcgtctccaacagtcactacctgataacgatgcggatgatcataattcacatcttcctcgataggtactccgttctgcgaataaaacaactctgccatgcggaatgtcggatacacctccggtatgggacctgaagtatggctccagtccttatccttaaaacagggaagtatgcgttgctgcaactgcgcggatgtgtttaccggattaccccaaatcaattcttcattccatttctcggtggatgcaccgcgaatactcatgcctcgccgcgtttcctccgacaaatcatagcgcgaatcattaaactcatataattgactgattcctgcctctttgcatatctctacagcctccttgcaggctacagcagctacattccatttattagggtcttcttccgaaaacagcttcatacccctgttatctgtcagatcctgaaaatcaggatttccattaaacaacggactggcaccggtcactctcgcttccgccaataaggtagcggcaattggacgtgtaatacgtcccatttcatttatcacatcggtgatgctcaaaggaagatccggaatcgcttcctcacaaagctgacagatataatcaacacaatcatcaaatgtatccctatatacccttacttcttccgaagaactacctatcggcaaattctcttttaccagaggaataggaccatacatcctgagcagataaaaatgatagaatgctttcaagaactttacttccgctatccaacgtgccctgtcctcatcgttcaagtcgggccccaccttaccgatattctcaagaaagatattacaatctctcaaagcgatataaagattacgtgcgtcatttcgtccctcccaataattcataataggatcgttcgtgttttgctcaccgagtttcatcctgtctccccaataatgaaagagattgagatgataatcattctggttcgttccatattcgtcacttcccaatagtgccgggtcatacatcggatgccctatttgtggcatatattgatagattgtggcaagaaaacgttccgcacttacccggtctttaaacgcatgttccatagtcggtacattatccggcacaatatccagataatcagcacatgctgataagaccgccatcgtcattgataataatataacttgaatttttctcataattgcatgtttttagaaggatagttgaataccgaggttatatactctttgcaccggatatctcattccatcaccggccatttccgggtcccaaagtttgaacttgctaaacgtcagcagattagttccgctagcatagattctcaaattggttatgtgagcccgtctcgtatatttatcaggaaccttatatcccagttccaccgacttaaggcgcaaaaaagaaccatctctcatgaaccaagtgctgcgttgaatattgttctccactaatgtgccggacaatctaggccataatgcttttacattacggttatcttccgaccaatggtcatctgcatacactttaagcagggcattcttcgaaacaatggaagaattgtcgtccgtatcgacaaaaggagaagttttcttagcgtcaatccagaaagattcgcgtcctaatccctgaaagaagaacgaaaagtcaaaacctttataacctgtactcaaaccaaaaccatagacaatctccggggtggtaggataaccaataggcaccatatccgcttctgtaattttatcatcaccattaatgtctttatacttaatatcaccacccatataagttccgaaagattgcaccggcgaacttgccacatcttgctcatctacaaacaaacgctctgccacatatccccattgttgagaaatgggtctccccacttttgaacgccaaggagtagacgaataatcaggttcctcatatactttatactttgatttagaataggtaaaattggcacgccctgtaatccagaagtctttagtaaacgaatgattcaagtctatagacatatcaaaaccatgtccttcagccttcccgatatttgcctgcggagtttgttgcagccccatcgttgcaggaatatccgccctgctcatcaatatgttcgaacgtctttctgtataataatcagcctgtatttccactttatcgaataaacccagctcgatacctacattcatcttcttcgatatttcccaaccgatagattcattagcataacgcttgatgctgactccattcactgtatatccgaaatcttgtccccatatatatttcctaccggaatcgttcacattcacatccgactggtagaaaaaacggtcttcatctttacctatctggtcgttaccaacaagtccatacgtagctttcagtttcaattttgaaatcgcatgtttccacccatctgttctattcaaccaaaatggttcattggtcagaatccaaccgaaaccgatagaagggaaaaagccccaacgattatttttagcaaaacgctccgaaccattatatccaaagttaccttccaagaaataacgactatcataattataagtaaaacgaccggatacccccatattcctgtgaggcaacgaaagaagcaaacttcccgcatttcccgacaaataattgcgcatattataaaccaacaaaccactcacgccatgattcccaaacacacgatcataattaatagctgcttcaaaataagtggtagcatttacttgtttgcttccttccgtatagctcagccactcagaccccttatcgggattcaagcaattcagcacataagtatcattgattttatcatacatactcaccgcataatagtaaggtgtatattcgcgggtctgtacaaaataagcatatctgtttgtactgaataaggcacgcgcattcaagcccttggttataaaatccaatttttgctttacttcaaactgcgccatcattgtagagcgggaataatttttaaaccctttcaccatgtctgcatacggattgatatactgcccttggtctgtattaccaaaaagaatatgctctttataggcatttgcagcatccggtgcataataagcgggaaatgctaccggatcactacgcattactctggaatataaatcattaccactcacaatcggaccattataatcttcaaaagcaccatgcaaacgaactacagcctctgtagtttttgtcaagttaatatttatattggaacgaagcagatactttttcaaatcaatggcattgtcactgttttttgtagatcggataactccctggtcttgcgtaaaagaacccgcaatgtaatatctcgccacttttcccccgccactcacattaaaattcgcccgatgattgacggcaaagttcttaaacataatctcgttccaatcgttagccggataaatcagaggattagcccctctttgtgtcatctcaatcttctccatagaataaggcaccgcctgcatcggattacgcgtaagaatagcctcattatttagtttcatataggtgataggatctgccaattctatcttggaagtcggtgcagaaagagaagactcataacggaaagaaatgctggcctttccctctttaccttctttcgtcgtaacaagtataacgccatttgctccgcgcgcaccatataaagcagttgctgccgcatccttcataatagaaaaactggcaatatcgtctacctgcagccgtgctaaatccgaagatgacatttctaccccgtcaatcagaatcagcggtcctctggcatatgtgaacgaagtaactccacgtacaaagaaactggcatcgtccgaaccgggttcaccactacgttggtaagcaatgagtcctgccacccttccggccaaagcagtagtaagattggaactagggactttaagctctgcgggttttacagtagaaaccgatgcaataacgctttcttttttctgcttggcaaatgcaaccaccgttacctcatcaagctcatccggttttgtacgcatagtaattatcaactcagtccttcctttaatcgccacagtcatgtcttccattcccaaataagagacttgtagtgcgtctgtgggcaatacagctatggtgaacgaaccgtcaaggtcggtcgcaactccacgggttccccccgctacaacaatatttacccccggcaaaggttcaccttgttcatcaaccacttttcctttcaccataatagactttttcgtttgagcctgtttctgttggctcgattcgtaattatgcattccgtaatcttctgcaaatacgggaatgctaaaactcattccaaagaaacatgccacaaacagtttctttaaaaatacgtaggttatacgacaactgtgtatttcaatcataatatcgataaatgttaattaattattgtaacttcacaatgcagaaaaaatctgcttttcatagataatcattcaactgtttctcataggctacacattataatttagggttttacaaattttacttttactgattgtacatctttcgaattaggtcctgtcataagaataaattctccggattcaataacaggctccatatcctgactaagaaaagacaaatcctccgcacgcaattcgaatccaacagtacgggtctctccctttcttaagaatattttcttaaatcctttcaactctttcaccgggcgagtcacacttgcaatgacatcacgaatataaagttgaatcgtttcctctccgtcatattgaccggtattagttacatcgacactcactttgagtatctcattggtcgagaactctttttggctaacccgaggagcagaataggagaaagtagtataacttaacccatatccgaaaggatacaatggagatacaggagaatcaataaaacgattcgtccactttgtcagtttatcggttcccggacgaccggactgcctgtaattatagaaaacgggaatttgccccacattacgagggaaactcatcgtgagtttgccggagggattatatttacccaagagcacatccgcaattgcatttccggtttccgtacctaagaaccagccttctactatagcgggaacctgctctgtcaactttgaaattgtcaatggacgtccattcatcagaactaccactacaggctttcccgtatccaacagagcttgtaccaattcttcttgtacccctgggatagatatatccgcccgacttgcgtcttctccgctcatagaggccctctccccgatagctgcaatgaccagttccgattggttagctgcttctactgcttcggaaaagaaagaacagtctgttccggtaacgtcacatccttttgcataattgatttttatatgcgaaggcaagttgtttttcaatccttccaacaaggttacataatcatttacttctcctttcccagcccagtaatctctcagatactgcttattatcagccaatggtccgaccacagcgatactttttatatctttagccagaggcagaagatgattctcattcttcaacagtacaatagatttttgcgccgccttacgtgcctcagctataaagtcacaatttctaataacccttttttcccgcttcacatcacaaaaacggaaagggtcatcaaataaacccaacttgaatttcatgcgaagaatcctgcgtaccatttcatcaatttgcccaacagtcactttcccttcattgattagagctaaagcgtgcctgttatattccccgtctgccatatccatatctactcctgcattgattgatagttctacggcttgcttggaaccgtgagccattccatgtggcaccaactgccatatagctccccaatcgctcactacaacccctttaaacttccaacgattccgcaagacctctgtcaataaccatttattcgcagtgcatggtacacctgcaatatcattaaatgccggcataaaagttgctacccctgcctctaccgccgctttgaacggaggcagataaatctcttccaacgtgcgttcactaatatctaccgtcccataatcttttcccgcctgcggcaatccataagccgcaaaatgtttggcacatgccagcaccgactcattgctacccaaattccactgatatccacgaaccttagcttccgccacccgggaagtcagccaagtatcctctcctgctccttccaatacacgtccccaacgaggatctctggaaacatcaatcattggtgcaaaagtccagtgtagtcctgctgcagcagcctctttagctgcaattcttgcagacttttccattaattccaaatcccagctacatgattcggccagaggtatcggaaatatcgttttatatccatgaatcacgtcatacccgaacagcaagggaatcttcaaacgagatcttgttaccgctatttcctggtactttctgatttcttctacacccgctatattcaatatcgaccctatacgcccggcttccaattgcttgtaaaagtcatcctgtgctttctgcggccccgttgccactccattcgcattactctgattgagctgaccgatcttctcagctagtgtcatttgctgtagcaacttttctaccttttcttctatttcaggagaagcctccataaacaagctctgagaattacctctttcaaaagataaaaaagcaatccataagattaatagtgttttcgttttcatagttgataatatttcttattcaaattggggaactaacaataccgcatcggccggcacagttcctatggcattctcactggagatctctacatacccttgctcagaaggttcaaaatgacattcatccagcaaataccattctccggtggtttggccttctatcttcaaagcgttaggagtcactataatgtgccgtgtacccctaccatttccaatcctgacagtatacgtatccgcctgcttcatcttgggagaataaatatagactttatacaatccttccttctttatcggaagctgatatctcactttggctatattcctgccatccgactcatgcgtacggaatgtaagtccatatccgggtttctgtttcgttttccagtctccggtcatctgaacatacgctgcctggtcatcatccaccagtatatctcccggtcggccgtcggaataaggattttcgtccagcaaccgtttaatgtcagacacacaaacttcttgcacatcacatttgttatctatggcgagactggccgctactgccgatgactgtgccagtaccataaaaaccggttccatacgaatagagccataagctatatgagaagcggaaagacaaaccggtaccagaagattcctgacttcttcccgacggggaactatgcagcgataggaaatcggataaggtttgaaaccaccgacttcgacatttccctcattctttacaaagccattgataacgtgtctgtcacaattatgcgaatccatagtataagcagcccaaccaatgccatcgtcacatgtcttctttccgacacaatgctgctgagtcatcaccacttctccaagcattctgcgcgcctcacgaacatacaactgatgtgaccaatacccattgcctacaaattcatctttcggataaccccatttcctcatttcgcgcctgatctcctttggaatccttctatcatgcccgacaaaataaagcaatcccttcgtataatccacatgttcttgccaaatactgtctcttttttcataagaggcttccggatattcccaattagcaccaatcatatccgtagaaaaagcacctttattattgatatcagtcttatcgccgggcatcaaactccagataaaaacatcttgtaaccctttccaaggctccacttctttcaagcgaaccaataattcatatttcttcgaatcatagttttccggccgggtaatgggtattctatttctcggattgttggtcaaagtaatcctgaaattataagcttgtatcttcttatcaccgctgcccgtaggttgaggaacagtatgatgtattccccacaacaaaccgcttgtcggatcacccttaatcttataaggatcaacttttcggttaaattgatgacctttatgtatttgaactccgtttagagtctcaccataagtagcattagactcacgtccggtcatatatgacacacccgcccgtgccatcaaatctccctcatatgaacagtctataaacactttagcccgaacactcctgtttgttgccggctgcggattatatgtattctccagcattatttcatttatcttcctttcagccactgtagaagatacgatacgatattcataccaagtttctatctctgccttatttatataatcgacaaaaatagattctgctactttaggttcaaaaatccactgctcaagcttaccatagtgcgttcccagtttacgataaaaatccagggccaatccttttaccacatatttattgccgatatccgtatatcccaatcctccggaagtcatcccacccagattacggcgaggttcgataagaatgacactcttccccatattcttagccgtatatgccgcaatgacacccgcggatgtaccaccatatatacatatatctacttcacgaaccgactgggcctttatgccatcgaacacccaaaagagtaaggatattaaaaccgtatacttcatatatttttctattatattaattcatgcacctcttcattattcatcatttcttctgattgaccatgcaaacatagtatttcatgaggttatgcactcattctaaagtctcaaacactttctattttatctcaaccaggctttgcgattgaactatcacgtatttatacaccacataatcattcattgaaggtaaaaaaacctcaattgttcctttttcatccactattgtctttatcgctttaccgtgtcccaacagaggtacacattctatttccgttcccggagccaaccaagtttttacatgataagattgcaaaggatgatactctcgaaaaaaaataaagtatccttggtgctcccgtatagattggaaacctgtccatgacctgccgtcgggcatatcacctaccggcaaaatgattccctgatgaaaatcatgttgaaaaccacgatatttttctacctgttcacgcaacagcaaagcctcttgcggcagattagttccctccatccaagccaatggctgccctgccatagtaatggcaaaaagatattcaaatgaataattagccggcccgaaaggatcattggcatacttcttctcattacgccatttatttaaaaattcaatttgtagcttttcagcaggtacatatttggaaagctgccacaagttacgtaaagtccaataaggataataattctgccaatctgtataccgattttccaagaatatatttccataccgattaaatgtatggtatcccccacggcgaccggccgtcgcatccaaattaaaaaccacttgattgtcggtttcagccaaaacgtagtcaaacaacctatgcaaattcatttccgcttctttagtcgggatagacagtccatcaatcttaaatatacagatgccatattctttatataatctgataatagcttccgcatcctttttccaatctgcaaaattatcttgtatgctgggattaaaccacaatgctatgtcaatgcccagttctttgcctctttttatgataggagacaatccgcgaggatacttgcttttatccggtgtccaataatccggattactccatatatccttaaaagagcctttcgctactgccgaattaggactcttcccggtttgccagccatcgtcaatctgaaaatgagtaattcccagttgaaccgcccgctctaattcccgcaagcaaaatgcctcgtttactttcgaatcttgactgcggtctccccatgtattcatcattatcatttcatcccgttgaggaagcagccggcgtatttgtttctgataagtacgtaacgccaccaacttgtcaaccgcttccggaccataaaccccgataacgcatccataagcaggagtccatttgtccggagtaatatctttctctgaaacccctaggcccgtaacagtaaagctcccaaactcagccataaaatcatatccttgataggctagctgtacatttgagcaaggagcctcttttagaaaaaagaaaccgttcttactgatattttcacgaacttgtaatagatttccccgataatgatttttacgataagacaggaagtttctctccaccactaaattattattccagtctgtcgcatcaaagaattcaatacaatcgacattccagtgttgccctttgaaattcaatttatcaagcgtagatgcagtttggttaatttgcatatcttcaaggaactcaatattctttcgatcggcattattcaactcctcacttttccccagaatggacacattcccttttaaataggtgttgcaggcgatagccggacaatcattatatactttataaacacgtttaacttgcaactgccgtaaagcaaactttacttctatctgcaaatatgccgggtgaatagttgtttgcgccacccgtactatatctacagaagctttctccgcctccacaagttctttatttaattgaaaatcaggagtacgtgaagtattcctccaggaataccgatttgttttatcagtcagtgtatgagttatcagatttccattattccaaagaaaagtacgttcaatccgattattccccataatcaatgtatccttctttaaataaccataaaaagtgtcttgagccaccaccgtctttcctaaaagaaataacaaccccaacagaaaaaaagacttcttctttcttcccctattcaagtgtttttcaaacaatagctgtactttcatcacatttgtatttttaaattctgccgtaaaagtagaaatgcttcttcacagatacagaattatatatctcaaaaacattcttttctgtctcatagaaaagaaacaaaagaaaaaaataatatatttgcagcatgtatcgtttgtggtttacattcattataactttgttttcctgctttcattctatgacagcaacaacacatgacaagcctttcttctttcaacatctgactatggaagacgggctttccaacaatcatgtatcagctattttccaaagtaaggacggaattttgtggctaggaacacaaaaaggactgaactgctatgacggtcataatttcaggctctataaaaaaagagattcatccaccgccaacagtattagaggaaatggcattaaaaagattcttcaagaccgcgacaataatatctgggtacaacacgaaaaaggaacggacgaaatcaattacattacccgaaatgtccgacatggatgggcgcacgactctatcggaaaatcagttatcgatatctgcactgactataatcaacaactgctcatcctctgcgatcaggaagtatggcaatacataaaaccgtcacggtcttacaaacggttgttcactgcccctgaaaactactccctattctctctaataaaagataaacaaggaggatattacattggtacccgacaatatgaggtgctaagatgcgacagcaactggaatatcacatcacgaatccagtctgcactaaaacaaaaaggtccggcaaacaaaggattggtttttcctttgtgtatagactcggaaaacagactttggtatggcataaaaaaccaaagtatcgaacggtatacccctcaaacaaagagtatcaccaaatatagcttatcgaatacatcatttatcaatcctgacgtacgcgacatgattgaaatggataaagattatatgcttatcgcaacttttaacggtcttttcagattggataaagaaaccttgaatccttctcacgttctttctccacaaacagaggaagagggcactttaaaccatttctcgatttatagtctctacaaagacaagcagaacattttgtgggtaggtactaatgcaggaggcgtgaatttttgtcatccttacaatcaacgtttcaaaacgatccatcccaatctgtttttaggacgcatggggatgatacgcaaggaccaagaaaacaatatatgggtagctacagaaggcggaggattgttctcttacaaccagcaaaccggttatcaggaaaattatctagtacacggcaaagagaaatcaacctattatgccaatatcctcaaatctctgtttattgacggagattctatctggtgcggcaatcaaaagggagagatttttattttctccataaaaaagaaaaagttctcattctacacacgtctaggtgacagtaatatccttgctatttttaaagactccaaacaacatatctggattggcaccaaacaagaaattatacagttagcaaaaaatgccgacggaaaatatgtcaaacagtcaactagcagtcttattcccatagaagacgtatgtgtcatagaagaacttccaaacgaaatcatactgttcggttccaaaacgaaaggtatctatatataccatacgtcaaccaaccaatggcaacatcttgataatcgtttctttaaacttccggaagataccaacatcagcataacttctttctgcaaaacgaaagacaaccagatatgggtgacaacagaaaatcaagggttgttcctattggatacggactttcaaataaaggagcatttattccattcgggaaacaattatctggaagatttgtatcacgtagcagaaggaaaagaaaaccagctatggctgatgaccaacaaaagcattcttttgtatgataccaatacgcgcctcatccgttcatttgacagccataacggacttaacctgaaggacttcagtgcctattcttgctggatggatatcaatcggcaactgtggttttcgggcaaccggggaattgcaatgctggataccgaaaattttccactaaatacatcacgttctccaatcatcttcactgatttattggtaaacaaccgtgttcaacaccctttggcacccgaatccgtattgaaacagaattttaatgagactcggacactgagccttaattacaatcagactaatatcgctatcagttatacctgttccaatttcatctatccggacaacaatacctttttttacaaaatggatggtgtagatgaagagtggattgatgccaacaaccggaaaacggtatattacagtaacttgcgcccgggacattaccggtttcatatcaaagccttcaacaacgacaatatgttctgcggagaaaaagagatagaaatcatcgttctccctcctttttggatacgctggtgggcatttcttatgtacgcagtcattatatacttgttgatacacagatacgtaatataccggcagagaaaacaaagactagagcatgaattgcatctgaaacagattgaacaacaaaaagcggaagaactgaatcatgagctgcaattgtttttcacccaagtggcacacgaatttcgtactcctttatctttaatattaaatcctctggacgaaatacaggataaaattatacacatagcaggcgtgcaagaagcattgaaacttatccgcagaaatgcacaacggttgctggcattggtcaacgacctgatggatttgcggaaaatagaatccggaacggataagctaaacctttctaattttgatttcaacgatttcaccaaagaagtttattatacttttcaaggaattgccggacaacgtcatctaaaatttttgttaaacttgccaaatactcccatcatggctacttttgacagagaagccatggagaaggtacttttcaatttgctttccaatgctttcaaatttactcctgaaggcggagaggtacacctgtccgtcaccacagaaaaaactgtcgaatccaaaagtatcctgattgagataaaagataccggtatcggtatctcgcccgaagacgttgagaagattttccgtccctttgccctatcacgtaaagacttgcatggaaatatcagcggcagtggagtaggactgagtatcacccggacaattatagaacatcacaaaggaaccatacaaattcaaaacaatcctccgcacgggacttgcatccatatagaacttccctgggtattcaatccccaatacaccatctcgcccactatcattgatgaagaagacgtgagaaaggaagacatcggacaattcccgctaaaggtaaatctgctcgaaaaaactatcttgctggtagacgacaatcctgagatactgaactatctgaaaaaagaacttggaaaatctttcaatatactcactgccaccaacggaaaggaagcattgggcatgttacaacaacagaatatctcattagtggtgagcgatgtcatgatgcccgaaatagatggtatcgaattatgcaaacgaataaaaacagaccataacctgtctcatctccccatcatcctactcacggcaaaagccatgaatctgtatatagaagaaggcttccaggccggagcagacgattacatcgtcaaacccttcaaagtgtctacactgaaaatacgtatcaaaaatattctgaaccgacaagagaagatgaaaaagatttacggcaagcaattatcattgaagagtgccggcatagaagtagaatctatagataaagcttttgttgataaatacattgccattgtcaaagaaaacatctctaatccagatttcaacattgaccaactttgtaaagaactagctataagccgggccaatttatataggaaagtcaaagcaatcactaccttatcaccagcggaaatgataagaaatatacgtttggaatgtgcttccgaattattacgcaactcacaactgactgccaccgaaatcgcaatacaagtcggattcggcagttacagccatttcagcgatttcttcaaaagtatatacgggatatctcctaaaaaatacaaagaacaatacggaaaatcctgatttaacgcagttaagctgtaagcgtctccgcgttgccgttactttctccatttgtccggtaacagttcccttagcacctttttgtcagtgtttggtttaatcccaataaatctgttaagtatgtctttgaagtagtcgaatgtgtttatcccgttaagtctgcatgagcacgccaatgaatatatcagcgccgctctctttgccccttgatgacttccgcagaatagcgagttctttctacttaaactgatatacctgtttaacctttctatctcgttatccagcttgtagtccggtttgagcacataattgcacaatgccggatattcattcagggtataattgaccgccttgctcaaattacttttgggcagggttgtctttttcgtctgtatttgcaacagttcatcttttaattcgcttaatatagggagcatatgcttctttctgtattccatgacttgtccgggtgggtattcaggtggcattttcaaggtatttcttatagtcgaatactatcttctccctttttctggtggaagacaagcaagttccgattgtcccacatattgtgggaaagtattctctaatattatgggaaaagattctcttattttgtgggaacaaattcccataatatcagagaatactttcccataatatatgggacaaagagaatatgtacttctctgataatggttgactagttgtttctttattcttgttataggttggcaggaaagacactatgagaaatgaatccaacaagtatgagaaacagggtaaaatcgggggtatttgacggaaaaactatgagaaatgctgttttagaaatcatttctcatagtctattctattagctttctgctacttatgattgatgaatgagaatatgagaaatgaaaatgaaaaatcgtttgcagggagcggtaaaacaagacggcagcgcggagacgcttaccggtacaatgtgaaggaggtgaagagcgatttatctcatcttttacgtttccaatcaccataaaacaccgattcacaatcatccgggctaatgtgaaacctatgaaccttcgaaatgcctctttatagtagaaacttcaaaagacctcaaagaaagaatcaatcaacagtgtaaaggttgagtcttgcggtatctattccatatacgatgacaggtgccccggtcaatgatatggttgccttatgatcaggagctctcaaccgtattttctgtccaatgacgttcaccaacttcagactttctccggcagcagggagttccaactccgtgtgcacacgccatgtatccacccaaggttctggagacagggcattgtgtttctggataaacccttccgctctattccaaaggacggccatcgccccgctgggagtgtcgaacagcaatcctctatgatggctgttctcatctgggaatttaatccatcccttgcatgttgccccgtccagtgcttcggcaatcgtgcaataagccatcagtgaaggcttaaagctaagatctctgttgataagaccgaagaaatactcccggttgccggcattcactcccagttggtcgaaccaaactgaattaaacaattggtaataaagagcattcttcactccttccgccgctgccaatacatacgacaagactacattctcggcagaaccacgaggagtgtcgttccatgaatgattgggataatccaacgcataaacctccgtcaaatacagttccttatttccgccatgcttctttataaaatcatttgccaatcgaatggaagcgtaataattccaataaggatatcctttaaccggtttctgatattttttccacggagtaactacaggataatcaggagtataatttcctctacccggatgcaatgcaatgccatccaacaagtcccaaccaccaacctctaccaacttattcataaatatttcatcccaacctgccatgccaaatgaaatcagtttaattgcctgccattccggtttttcctgctgcacccggcgaattgttttcagccacgccacataaggttcaagcaacacagcgcctccgatgccatctttgcttacggcaatacctgcattatccatgttgatttcattgccaaactcccatatcctattgccattgcaaaccattttttcaagacaagcacgaaccgttcttttacgcatctgttcgtcccattcctttttccaattaacattattatggaacatcgcccatatagaaggaaaatttgccgtatctccattccgcaaccattttactcccattctctgcaacaagcggctcaaattatccaaatcaggaatctcccaataggcagaaagccccataatgcttttctcaggagaagaaaaaaacttatgaggaggcaatacgcaaatattagttctggaaaaaacttgctcacgcccctcattgtcgaccagagaggcttctacaaaaaacaaatcccgttcttgctccgacctgaaccggacaggccgaacaacacactctccgctagctaataccaaagcttcgctctgtctgacaactacattgcccttaaaatcacgtacccaataatttaacctaaagttctttttttcttgagctgtattggttacgttaacattcacttccaaagtctccaaggcgtcttcccaccagttgtaggttttatctgtagtcagagtcagtgcaaacggacgcccgtgccatcgtgagctgatgacctcgtaagattcgtctgccgaagcaatcacaacagaaaagcgagtatccagaaccttttctccctgtagacttttctcagtaaatactgtatgtctgaatccctcgtctttccaattaagattagcagaattacctttgttatacgccaaacatatcttataattgccgttccgaaaaggaacaaattttgcatcaaactcttcaatgggaagcccaccttcagaatgacgttgccaaagaccagttttcgctacaggcagttccaagctccgctcccctaataaaacgaaacggaattgggaaccgccccatttcttttctacatatccttcgggcatcccactaacagtataatggacatctaccgcagaaggacgtgctatataagtacccgtaagaaccagcgtctccggaattttccttccactgtcatctctttcaggaaacgtaaaatgagcacgaatagcctgacaaccatcctccttcaccatttcataagtacacgcttccggaacaatcgccggtgaccatcccaacctcatacttcccaaccggacaagcttttccgattgtttattcataacaaatatttcgtcaaaaccggatgcttgaagaatataacttgcagtttcaatcctacaagtctccttagcatatatggaatggttgcctaagcaaaatagcataccgatatatataaacggccacaaaaggacctttaaaagaatattattccgtctttccattgataactacggttttttatagattttcattgcgcaacctccacctggcgccatagatatcttcagtttcctgtctgcaggaatatcaatcacttcttttacatagtcggatgctactctgtgagcatttgctccatcacgatagacttccgccgcaaacgcaccttcaccgacaaacgacaagtcaagtgtcaacgtgcgttcatcccaattagtcattgctcccacataccagtcttttcctttcttacgggcaattgccacatatttcccgatagccccatccaaagatattgtatgatcccatacagtggggatcgaagttataaaactcgtacattccgcttcgcgctcatacatagaaggactgtcacacagcatattcaaaggagattcaaaaactacatactccgccaactgacgacaacgagtgccttgactcatcggctcctcagtaatatagcggaaattctttttatttgcgttacgcatggcaccttgcgtataatccataggtccggcaagcatacggataaacggaatagtcacatcataagtcacctgatctatattattactagtaaactttaattgttcaagcccatgcactccctcaaaattaagcacattcggataagtgcggtttagtcctgtcggcttataagctccatgaaaatccagcaataaccgatgttttgcagcaatctccgccgctttatagtaaaattcaaccatcggctggtcatccctgtccataaaatcaaccttaaaaccttttattcctaactcggaataatgcttgcagactttctccaaatcacgattaaaggcataatatcccgcccataaaattaacccgacattacgggaagcggcataatttatcagtttcttcaaatcaacttccggtactacctgaaaaaggtctgccttcaaattcacagcccatccttcatccagaattacatattcaacgccatgacgagaagcaaaatcaatatatgccatataagtttcattattcactccggtcttaaaatcaactcctttcaaattccaggcattccaccattcccaggcaacttttcccggacgtatccatgatatatccttcacgcgcgaaggagcagcaagcttatagaccatatcattatctgccaactctttatcattctcggaaacgacaacaatacgccagggaaatacagcattagcctgacaactagcgatataaggttcgcgcacttgtatcacttcctgcaaggaattatatcctccttgctttttctccttgggataaggagcatatactccctccaatgcgttccgatctttcgttttaaccagaaacataccgggatattgttccaaatcagcctcagcaatacataatttacgattatcacccgtctcaacaaccataggagaaaataacagtttatgaggattcatccggctaatggcctcataagtatatatattttcaaatgaattaaagaactgcttctcacggtcttcgcttttagtacggacatacggtatgtaagcattccggtctgtctggaaatgaaaacgcgcttcttccgacactaccgtaaaaggcttatccccgctcgatacaaaacgataggccataccttcattatacatcctgaaaataaggttaaaaccattcttaaaaaccagtgtcatctcattgaaatggtcagtaacggcagcacgtttataaaaaggagaagctatcgtcttattcaccgtattattacgcacagaccgtacttttgagtttggtccccacacctctccgtctcccaatatcatagaaatagaagaaggataaatcaaagtatcgcctttatgtaacaatgcataagaaagaacattccccgtttttacagacaccttcagttgtttgtcaggagagaatacttcatagcgtttctggctccatcccaaagtagccgaaaacagaaatagagaaattaatgtaatgtttttcatatttattcttataacttggttttaaatgattgagagcaaaactatacatttcattccttgctaacaagcgttgcaaggctaaatttcgggtatgagacgattccgcaagtttttgagacgcacgcctttcttacctatgtttataagccctacttttgtaagcatcattacggaaaatcataatcaccattcaatcaaaaaataaaatgagaaagtatattgtttatatcctactacttattaattacagcatattgctgaatgacttatcggcacaacctataaaaaaagattatagccggaaagtagattctcttcttcaacaaatgacgttggaagagaaagtcggacagatgatccaatactccaatgacaaactccagacaggtcctaccatcaaaaaccaaaatcatgtagaagaaataaaaaagggaatggtcggttcgatgttcaacatcattacggtagaacgtgccagacagtatcaggatttggctatgcaatcacgcctcaagattcctttgatatttggtttggatgttgtgcatgggatgaggactatcttccctattccattaggagaagctgccagttttgacctgaaaatgataaagaagaccgcccggatagccgcttccgaaacgtcagcatacggtattcactggacctttgcgccaatggtagatatagccagagatgcccgttggggaagaggtatggaaggtgcaggcgaagatacatggtacggaagccaggtagccaaagcgcgcatagaaggctttcagggaacagactattcccgacagaatactgttcttgcctgtgccaaacatttagctgcatacggtgctgccctcgccggaaaagactacgcggaagccgatatttcggatgctacactccatcaagtatatctccctccctttcatagtgctgtaaaagccggtgtagctacgttaatgacaggattcaatgaaataaacggtattccggctactgcccacaaatatcttcaaagtgagctattaaaagaaaaatggggatttaaaggttttaccgtaagcgattggggttccattggagaaattgcccgacacggaatgggcaaagacaacaaagatgctaccagaattgccgtcatagcaggatgtgatatggatatgcactccatgtcttataaaagaaatctggtcgaccttgtaaacgaaggccaagtagatgtaaacctgatagataatgccgtaagacgaatactgacattgaaatacgaattagggctgtttgacgacccttattgttacaacaacagatatcaggaactaagtgataaaaagataatcaacgaacatcgaaaatcagcacgcctgatgggaagcaagtcaatcgtccttctcaaaaacaatcaagtccttcctatccagccgcatatatccaacatcgcactaatcggtcctctcaacaaagcctccaaagatatgttaggcaattggaaagcagtaggagacgaaaaagaggttgttacagtcgatgagggtttacgtaatgctatcccacacgcacaaataagttatatcgaaggatatgatttggaaaataatgaactcaaaccattaccggcattagaccgcttcgacatgattattgtagcggtaggagaaagagcaatggaatcaggagaagcaaggtcaaaagtggatatcaatatccacagaaatcaacagttgctagtaaaacaattaaaagaaaaaagcaacaaaccggttgtagcactcataatgggaggacgaccattgattttctcagatatggaaccttatgccgatgccatactaatgacttggtggttgggatccgaagcagggaactctgttgcagatatactcaccggaaaatataatccttccggaaagctaccggttacttttcccaaacaagtaggtcaatgtcctatttattataaccagaagcgaaccggaagaccttgggttcccaataatctatatgtcagcggatactgtgacgaaacagctttgcctgcctacccctttggtttcggactaagctacacacaatttgaaatagacaccccagtacttgagaaagagaaatatttttttaacgaacctattaaggtaaaagtaaaagtcagaaataacggaaaatataaaggaatagaaaccgtacaactctatttacaagacgtcgtaagttccattacacgtcctctcatagagctttgcggcatccgacaagtagaattagcacctaaagaagaaaagattgtcgaattcattctgtttacggaagatctttcattttacagccatgaaaaagtattcattactgaacccggcgagtttaaactatttgcaggtaatagttccgacaacctacgggctacctcttttgaattactggagacacgaatatcttccaacaaatagcctgacttcattcagatatacaacataataactgaaataaataacatttatgagaactaaaaaacacatcatcctgacgttattgtcactcatcctggtaagtcaaaactgtcggtctcaggagcttatcgcaaatgtctatggacgcaactaccaactactgaatggcaaatggaatgcaatcatagacccttatgaccaaggcatccgaatgggtatgtttaagaataaaaagcctgtgggtaaaactgatttttatgaatactcatttgaggaaggtttaattttgaacgttccttccgactggaactctcagattcccgaacttaaattttatgaaggaacagtttggtatgctcgccatttggacatcaagaaaaaggaaaacgaaagattgttattatacttcaatgcagtcagttatcgttgtaaagtgtacctaaacgggaatgaaataggtcagcacgaaggagggttcactccttttcaaatagatataactgataaagttaaagagaatgataattttctggctgtagcagtgaataacacccgaaccaaagatgcaatacccgccatgtctttcgactggtggaattatggaggaattacaagagatgtcatgcttgtaacagttcctcaaaagtatattaaagattattttatccagttggataaattcaattctgataaaatcaatgcgcatatttctttgtcagataaaaaagaggggcagaaaataatacttgaaataccggaactgaaagtaagaaaagaattagtaacagatctttcaggtagcgcacaactctctttcacaacccgaaagttacaacgttggtcacccgaatctcccaaactatatacagtcgttatttcatccgattccgataaaatagaagaaaagattggatttcgtaatatctatgtgaaagaagaagatgtttatctaaatggcgcccccatcttcatgcgaagtataagcttccatgaagaaataccacaacgcaaaggacgcgctttttcagaaagcgatgcaatcatgctattatcggaagcaaaagcattaggagctaacatgattcgtttagctcattatccccaaaacgaatacatcgtaagaaacgctgaaaaaatggggtttcttttatgggaagaaattcctatctggcaaggaatagactttggtaatgaacaaaccaaaaataaagccggtacaatgattaaggaaatgatcatgcgtgataagaaccgatgtgctcttatattttggggagttgccaacgaaacagccacttccgaacctcgtaaccaattcctcagatatttaattaattgttgccatgaattggatactaccagactcattactgccgcatttgatctggcaaggtataatcaagaaacaaaagccttcgagatgaaagatccattcataaaagaactggatgtggttgcaatcaataaatatatgggatggtatcacaattggcctgccaaacctgagcaggtaaaatggaatatcgcatctggacaacctctcattatatcagaattcggaggggaagcgttgtatgggaaaaaaggcaaagttgatatcaaaagttcatggagtgaagattatcagacgcaattatatctggataatttaaaaatgttcagccatattcctaatctacgcggaatatctccatggatcttatttgattttcgctctccttttcgctttcaccccaatcaaggaggtgaatggaatcgcaaaggcttagtatccgatcaaggataccgtaaaaaagcttggtatatcatacgagattattacagtagttttaataagaattagcgaacgtcttataaaataatggaacgaaatacatgaggatgaattatttatcaaatattagttttgacacatccatcctcatgccataaattagttcatctttacaaaggatattcctcaaaagcatacaaaatggtagataaataacgttcacctgtatcgggtaataatgcaacaatcattttcccggcattttccggtcgcttcgccagttccgtagcagcatatacggctgcgcctgaagatatgcctaccaacaaaccttcctgtttggctaattcacgactcgtacgaatggcatcgtcattctgcacctgaataatctcatctacgatagaagccttgtacgttttaggaacaaaccctgcaccaattccctgaatcttatgcggccctggttttcctcccgagagtaccggagaatcagaaggttctactgccacgatctttatactcggatcacgcatcttcagcgcttcacctacaccgctaactgtcccgccagtacctactccggctacaaagatatcgactttcccctcggtatctctccatatttccagaccagtagttcgtaaatgcatggcggggttagcaggattctcaaattgttgcaagatgactgcccccggagtgaccgctttcagttcttcagctttggcaatggctcctttcataccatctgcaccaggagtcaatactaattccgcacctaaagctttcagaagattacgccgttcgatactcatggtatcgggcatcgtcagaatcagtttatagcctttagcagctgaaacaaaagccaatcccacaccggtattcccgctggtcggttcaatgatagtcgctccgggatacaaaattcctttcgtttctgcatcctcaatcatagccaatgctatgcggtccttcacgcttcctgcgggattgaaagattcaatctttacaatcagacgagctttcaggtcgttacttgtattatagttactaagttccaataacggagtgttacccaccaaatccgtcaattttcttgctatcttttccatatatatctgttttaaatttctcttgttttaatatatgacaaagatagtgcggattctgttcagggtaaataccatatatgtggtaaattcataccacatatatctgacttcctgccagatattatattaagaaatcagctctcatagggctgaatgtatcaatcaatacacctgcttccagacaaacacatccatgaggctggtcaggttccacataataaccatcacctgtagaaagaatttctttccgatctccaatggtcaattcaaacttaccgcttgcaacataagtagcctggctatgataatgttggtgcatagaaccgacggcacctttctcaaattccactttcaccatcatcagttgcccgtcataccccattatctggcgacggattcccggagccggtttctcccaatccaattctttctcaaactgaaaagcatcactgcgtgttttcatcttccaatctattcttatttataactatattatttgaatctcttcacataatctgcaatcagataacatgccgggccgagtacttgcccatgatcgaatccttgcatttcgtacaaagtcactttcttgttacctatacttttcaagacagcttccaacaacgcattttcttcatatcttgccgccatctccagatgcttgtcccccgtaatcaacacgagaggagctgtttccttacgagccttatttaccggagcatactcatcaaccaccggaataccgtcaggcaaaccgcgttccttacgaatagtgaaatgtgtcaccgtctgaccactcaccggaagataagcagctacactatcggcatctgctccatatgctgccatgtactttttatccattgccagaatcaacgaaagatagcctcccgctgaatgaccggaaacaaaaatgtgatccttacgaccaccatacttctcaatattcttgaaaacccatgccacagcttcagccgcatcttcgatgtaagccggattctttgctttcggactcaaacggtaattcaccgccactactgcaaacccttgttctctcaattctttgggaataaatttatttccaccttccataccaccaccgtgaaaccagacgatagttgagaaatccttcttgttttcaggataataaatatccagtttacaacgttccagacgataggtatccgtttcggagccagagacataagatatatctttgtttgtgcgataagcattttgtgcttgagcaatgcaagcacaaagcaaaaagagaagaaggcaaatctttttcatggtttcatttattttatattcatctattagtactattcttaaaaattactttagagttaataatgtcatgttcatcaatatataattcaggattctcacctgagctttccaccaaagcttcgattgtgatacactcatccggcagccactgtttaaaatgtagcatattatctctcagttctaccatgttattttccgtggctgataattgaatcatcttttttatatttctcgtatataatggaaggccaccccctttaactactaaagaagattgggcaccttccccaataatattcttatttcccgtattctctaacgtataacatattctccaaagattttcaaccagtatcgtatcttcatactgtacaaagacagtaatccccggtattttaggtttttgcgtcagcaatgtactctctgtacagcaaaccgtcactctgactttttctttcgagaaatatgaaagcaaagtaaccactcccgctagaattgtgactgttgtaactacaatttctatcatatgtctgtgtctttttttcataattactattctttagtcagttccctcaatcgccatgcacaatctttgaattgcttatcaatatacgttagccgctcttccaattcatcaatttttcgtaaagcatcttttacatcaatctcctttctttcaatcttatcctccacatatttaattactttcaagtcatatttgttatgccgtatctcatcctgcgtagcaacatagaccggacaaccgtttttttctccccccacctcttctccgataagaaacttcttatatatattcggaagttgttccaatactttatcagaaagtttataaagacctttattcgaaatataccccttccgtgcgtcaacgaataaagtttgcgtcctcattctttcttttctgaatacgagaattgccgtagaaatagccgttccatgaaatagattcgacggcaattcaataaccgcctcaagtagattgtattcaataatctgctctcgtatcttgctttcagtatttcggaacagaacacctaccggcactactacaacagcttgtccatcattccgcaaacttgccaaaatatgacttatatatgcccatgtaacttgacttttaggaggaataccatatttaaagcgtctgtaaaaatcatcataagcttcctcagatgcccacttatctgcaaatggaggtacagaaacaacaatatcaaactttttcaaccctccatgatccaataatttaggactacgaagactatctccccaaagaaaagtcgcacccttgaagccattcagcatcagattcatttttgtcaatgcatacaaattccaattcacttcctgcccatagatatcagtacccctgatccccatttttttaccgacctcaatcaacagagtaccactaccagaagccggatcgcacaaacaagcattttttctattgccatctattagtttcgtgatcaaactaactacctctgtaggagcaagtacattatttatctttttccccgcctcttcagcaaaaatatataataactgattatataaatcaccaacatctatcaactgcccgatagcatcagtcaacctgacttcttgaaaaagttgaaggagtccacgcaatttactcgatcgcgtgtttgcttctcctaatatattactttcaaaatcaatagctttattgatttcataaccttcagttacgaacccatttgcctgctccaattcataaagagccatatttatcaatctaccaagatccggtgaatcaagcgctttacatagataatcaaaagaactacgctcggacaccaataagtgtagagtaagtttgttatcgtcttgttgaaaagaatcattagacttataatattcacttgcagacttcagaaatagcaaagccaatacataatccctacactgattggcagaaagcgttccacccaagatttggcgcgctttatttgcaatataatacgctttttctttcatagtacaatcattttaaagaatccatcagcaactgatcctgcaaactttgtttaagttcatttatttcactacgaatacattcactttctcttctcaactgatccatttctacaacaagcttctgtacttctatagatggtatatcaagctgtatttctcctattaccgattggggaatcacttgaatgcccgtacctaccgctgcgctcttcaacataccaagaatagacggcgtatttaaaaaacaacaaagaaattccggtaatacatcactagtaatgggacgtataataataaaggatgaagatgctatagtacttcgttctgccccctcatacaatatgcaataattagagcctcctttagccgcaaatagcaaatcaccttttttcaaccaatgcttatcattaattcctgtatttattaccgtagctacttgagtataatcaagtcgactctccggatcaacatccttcacctgcaaatatctgacctcaccctgcgaatcagttttcatatatataccggattgcatcatggttatatcctttaaagttactttcttattcattatttcttttataatacagactctacttaatataattaattcaactattaaaataactatctcccggttatcaacatgctcacaacggatagataccacaatatatagcttttttcattatttacaagtaatatgaaggaaaaaaacaggtaaataagcaaaatatctctttttattcactctcttcgaatttagtcaagtagagtttctactatattaaagacatgaagcgagatatgtataaattgaaaagaatttcatcgtcgagaaaaagaagaacattgcaacctatccatggacgtcagcagatgttcccataactattcggagcaaagcataccgactacccggctgaacagaaaaccgtaattctaccggttctattgcttatcttgtacaacatcatgatagtccggaacccaaagaatacgacatcgaattaatcccttatggatgtagtaccctacggataacgctgtttcccgtaagataagttcaataagtattagagattttgtttgcgtaacatataataaaaactataaattgaaacctaaacatgaaagaaagaaatccatataagcacctgtgtcctactctaacgaagtataatatcataacaatatacatagccggttcttatgaaagctagaacataaagcatctcctgaaggcttaaggctacaaactcttatggggtttgcagccttttttgttgcaaaaaatcaagtagaaactactaaaacggcagatgagagtctataataaactccagacccgtttataataaacgatgacggtttttattataaactaaaaaagagtttgtgcataaatggtaaactattttcaatagactataaaaacaagaaaacgaatgaatggttttagctaggattaatagtaaatattaaccacaaaactatcgttcataaatccggaatgtcaatagcctgccttgctatctgcatccacacgacacgtactttatataatacgcgcctgacaattatcaactatccggatgggttataactccaaccgggaagcttcacgtaaagaacgatcccgcattatggcaaatcactatgacccgcctcataaagcattatctgatccagtatcaccccctcgtccaatgctttaatgacaagttgatgtgattttttgccggaaacggggagtacgattttccggattgcctgattacgaagcacattctctttccattcttcgctacgtccctccgtttcataagctatcacttcaggctcggcaccatccaaagaaaccgagatacgcagcttatcaccctgtaccggatgattgggaagcaaccggatatctacttctaataaatccgttttcaaattaccgaaatagaaagtcagcgcatcaccttttcttatttctgcggctttaccttcatatcccaagccttcgcagacaacagcatttccttttttagcatccgccccgttccattgacaggctgccttacggtcagctatcattggagctgcagctgcttttcgttccacacgattgaatacaggaagcttgcggggcttgaaatccatcatacggttccattttccattctccagagaattgtagtgttgagtgagcgcggcaatgctatcataagcggcatcactcttttcccagtctaccttatcatggcgtgccaactgggcatataacaatttgcgattcatttgtgccgcagcctgtaccggatatttcaccagttcgaagtaggcgctctgtctgtcgacaggcactttagaggccgccttctccaccgtttccgaaagttcgtcgtaagcattcagacgttcgtttatctctctttcgctccacggcaggtctttgaccacccgataaatcggattattttcctcctcccgtgtatttcccataaattcgggtttgcggatatgcgccaagcgataatgttcctgcataacgggaagtacagcctttgcacaggaagttcccagttcccgttccagccaatgtttcagatgcacggtcactccttcggaagacaccttatccagattccatgccatatccatgaacagttcgatctgatattcggccggcttgatgtctccgacgttcagtatccacattttctgtattccctggtcataggccagtttcatctgctgatagatcagtgaaggactcatggtgcccagccataaataatcgtgcggacgtccccagtaagagacatgatagtaaactccattacctcctttacgtgcccgctcaacggcagtggggaaatggcggatataaccatagttatcatcacaccacatcagtgtcacatcttcgggcacttgcaatcccgcatgataaatatcgagtacctctttataaggaataaagacctgtggcacttgagtaacctctttatttacatacttttcaagcaacccgcgctgatctgcaggtacacggtccaagaccgctttctgctcttctaccgttttggcaccctgcatctttccatcgtgcacgccacgcatacctaatgtgtaaagtatctcttgtccggcaacttccttcacacgatcttcccaaaatttataaacagccggactgttattcacgtaatcgtatacgccttttccccttctcgaccattcaccggcagcattacatgccatcggttcgcaatgggaagcccccacaaaaatgccgtatttcttcgccatttcccgattccctttcgtcagaaagaaaggaagggtgcactcgtgcatagcaggccagtaagtattagcccgcaaacggagcagcagctcaaaaatacgttcgttggtacgcggaccgatttctcctttcacatccgacggttcgtaagtttggttgccccaaggcatcagtccccagtcttcatcattaatgaagatgccccgatactctacagaaggcgattgcaactctctgaactttgaagaaagacggaaggtttctctcttttcaggagtcacgtccgcccaccattcccaaggggagacacccaacaaacgggatatttcgagtatgccgtaagctgtaccatgactgtcactaccggctacaaccagctttccatcttgtgagacagtcagcaggaaagcctgttttttattttttaatgcggaaagatcaatacctgtttcgttgattagattactctgccctacagttcctaccacaatagcccctaccttatcattcagttcggtggttgcagacaatacagtccgaatatcgcgaccgagcatttccagcgaagtgcgtaccactagcttttccgagttacagcatgctatcgtaaccgtctgaccggattgcagaataaactctttttgcttgccctgaaccgacaagactgtcattaagaaaagaaataagggaagtaaggttttacatctcataagtttcatgtttttagattgtacaaaaatacgacatcaagttctaaaacaagatagaatcatgtacaatttgatagaatttcgttcaagcatccagtttaccagatcatccgacaagtagcaactgaatcccgggaaagcattgctctcctccgatttccattctctaaacaatatgctttcaatgttctatttttaatattctgcagggaaatagctaattagaaagtaacgaactagaaaataaactgcataaataattgcatgagcatacaaaaaacagcctaatattgcataaaagcaaacaggatatgtatctttctctattcggaaaccgttcattgctttaaaaccaacgaagtgttcctcggtgtgcatcgacttgttcctcaccggggaagctatcgtttcccggtgaggaagataaaaatggactattaagaagcattttttctccagtttatcagaatatgtcggaaagaaaaaaataacaaaatgattagttattcgggcatccactatccgaataacaaaaataatcaaaaatctaccgcagttcgattggtatattttcgaaacagcagaaatataaaaatcgcgtaattacaaatgcaggacatttccctgcttttctttaccaaactgcaattcacgtccttcttccaatgattaaatattccttttttaagaatcatcgttttttaagaaggttatttcaacttttatccttcaatagctcttttgtcttatccgccaaaaataggggaatattaatcaaattaccatcttgtttcaaattcagtattgaataccggatccggcaagcaggctggaaaagcttctcatcataaatcacatttttgatatcagaaatgtaataatttacacattttcgatacgagtttcgtgcgaatacacacattatccatataaaacgaaagaaaaattcaggataaatgcattgtattcaaatcgaagaaagtatcttcggtaaactacccaaataataaaaaggaagatttatcaatcggaaactctttccggcaaccgtcttcacatcatcaatagaatatggaccactccaaatacggacagctaaatcaccgccagacaaatccatgaaagaatgtaacgaacggagatgcgcattctttccgcatttcacttcaaccggaataatttgtgttcctttttgccatacaaaatctgtttcggcattggagccttgtttgtcacgtacccaaaaatgcaagtcggaaatatactgttcatcaagtaatacctgcaattgttgtgctacaatatgttcggcgatagctccttgccacgtatccatcaacgtacggtcatgcagaacttcagtttggatatttgcagcaaaattaactagtcctgtatccagccacatcaatttaggagcacgttttagagcaggcagcgccggtgcgtgcatagctgtaacaggataaactaaatgtagtataaaagctttttccaaaatattgaaagcttcacgcacttcctttgagttataggttgactctccaaaatttcccagtttaatagtctgtcctgccttgttccagcccgtccgcaatatatgccggatgacatacgtctgcaactgggtcggtgcatacttttcaacatcctcgttataacctttcaataaagaattataaatagacttcaaacgcaccaagtctccattctccgcataatcggctactacttcgggcataccaccaatcaatgtatatctatgaaaacgagacattgcctcttcatgcaacgcagatggcaaacttatttcatctatagcagtacgataatgcccctcgcccatagcagtcagatattctccgaaagtacaaggggaaagttgcatatattctactctacccaccggaaaagagatacgttctttcaacaatgactgtaaacgtgaaccggcagcgataacatacaaatcaggcatatcttcataaaaataccgcaacaatgctaccgccttaggcacattctgtatctcatctataaatagcaacgtccgcccctcacgcagaagaatattcttttgaaaacaagctatcttcattatttcctgtactttatccgtactctgaaacaggcgcgcatcttcttcacgctccagattcaaatgaagataattctcaaagttccgggcaaactcattaactaacgtcgtttttcctacctgacgcgcaccacgcaacaccaagggtttacgccctgtacgttcggcccacttttgcaactgattataaatatctctttcaaacataaaaatcattgttaatcagctacaaatataccattttattctaagaacataggcaatttaacgaaataaccgcctaaaaacataggcaaaatgaagaaaatataagcaaaaaacataggcaaagtaacccatgatttctgcaattactacttaaagataatcataatcttttcaccaacacctttatcaggtattctcacactacagacacctgttcctttatcccaactccacaccacagtttcagtgtcattctccagattttcttccaaacgttccggtttagttttctttatcttctttcctttgacagttacctctttcggggctttcgcagaataaatacggaacaacagatttctcggaccggggacagtgtatccttttccttcacgggcagagacagtcaattcatatccatttgccaaagtactgcaaataatcggtgttttgacaaattcatcacgctggtaccctaagttttctccttcatcttcgtaaagagtaaaggctgcctgtgcatcttcctgtgcggggaagatttcaaaagtaagtggatataccggtttctcgtgggtgtagttcatcaccggcatcgtagggatgatagaaccttgcttcacaaacataggaacagaagacaagggagcatcaacggtagtccattgctctccggtgtagaccgtctgcttgttgttgtagtctatccatgtaccttcgggaaggtacacgttctttgtgcgggcacctttcttcaccacgggggctaccaacaattcacgaccgaacaagaattgggcatccgtagaaaacgtttccatatccattggatattcgagaaatagaggccgcatgataggcaatcctgtatcatacgcttcgcgggcgtaagtgtagatatacggcaacaaacgatatttcagttcgatagccgctttcgcgttcttttccgcttccggtccgaaaagccacggttccaccggattatctccctcgtggtgaatacggctcaaaggattaaatgctccgaattgaatccaacgggtatagagttccgccatagccggataatcctcaacatctccacagtaaccggtaatatcacaggaagaaaatgggattaatcccaatccggcggaaagcattacaggaatctgattggctaattgtccccacccttgcagtacatcgtctccgtttccgctatcacccgtccaaccgaacgtataacgttgcaatccggcataagcagcacgagtcatttggaaaacacgacggtccggattcctcttttcaaattgctcttttaccactttgtcccaagtcaggccatagacgttatggatttcatcgtgcataccgagatggtgcttcatcaccaggcgttccgtctgctcctcgttactccaggcaggttcgcccatgtctgtccagaagccggagacaccatcgtcaataggtttctgctgataagttccccaccagtcggctacggcaggcagggtgaagtctaccactccgcagtttccaccccacggccagggcatatcgtagcttttaccgttcgtactgtcctttacaaaatagcccaggcggtctgcttcttcccattgttttttgttggcttgtgcaattaccgggtcttgagatacgactaccttaaaacccatctctttcaaatccgaaagcatcttcctagggttttcatagtttcctttgcgccattcgaaatcctgcaaatattctgtccagccgatatcctgatagataatatcacaaggtattctccgtttccggtaaccttcggctatttcacgacttagcttttcacttgtcaacagaccgcggcattgagcaaaacccaacgcccatttcggcggcatgataggttttccggtcagtccgacgtattggctgatgatttctttatagtctttaccgaaaataaagtaatatatcatttccccgttcggcgcttcaaagctgtaataatcacggctttccgttccgaatttgaattccgtcttataggtattatcaaggaaaataccataccggtaattgctcataaagaaaggaatactcttgtaaagaggatcttctaccacactataacaaggtttgtcactattccacatcttataagactcgccacgacggtccatctttcccgctttctcaccaagtccgaagaagtgctcgtcacgacgaagcactttatattccaccttcttcgttccttcactgacatggcctttatcggcataatcactaaacaggagtttctgatatttatcgaatatctgaagactcatcggagatttattcacccggatacgcaacttcggagtaaatatctcgtaacaggccgcctgttcatccacatgaatagttcctacctcttccagttcttcattaatcactgcaaacgaagcatttcttcgttgcaattgcccgtcgggtgagaaccagattttcacgacggaagagctgcaaagttgcaattgtaaggcggcactgtccgccaggtgaaaagtcacctgacgtccctgctgtgtaaaagaagtgcatgtacgtgtcgtattttccgcccaaacccatgttggaaatatcaggcacaacacccatacccataatctatatctaatcatcatacctatcattttagttattctgtagcagccgctttattcaaccacaatcatcgtccaatatttcagggaaggcaatgtgaatgagacaaccccgttctcctgtgtaaaggccaactcctgcaaagcccctccgtgtgcatccggcgacgctacccacaacttattcacttttgccgacagattcatttgcaaagctgcttttgtaatcagagccggttccggcatcgtaccgtccacatctctccagctaaggctgttcgcttgcgaaaagttaagaagatgtatcacttgcttgccacctacctgcttggcataagtagtaactgatccctgttgaggaggccagctattcaatctcatttcgccattggtacaattcatggaaacactattctccgtaccaccgtcacgaagcagattttgataagaagtcaggaagtcatagtaacgaaccatcgctgttttcaattcctcgctcattgtcaggttctcattcggaaagtactctttgcacaacatgtgatcgcctcccaactccaggtgcgaaccacccaaagcaaacatgacagcatctgtcaataagatacccggcgtattaaattctccccggttatccgctttattataattcatataagctgcaaaaaccgtattcaactgataattgccatagactccattttcataaagaatggctttcagattggtaaaatcagcctcatccgcccacacctcattatagaagaaatcaactttacctgtctcccctatctgacgggcaccgtaacggctgaccgcattcatcaccaaactcttgtccggatgagcctgcttcgtcgcttcaataaaagaagcatatccctcacgcagattgaccggaataccattgtaattgtaaagcgtgctacgtcgtcccaactggtctatctgatagccgtcgaaggcaaagttcgcgtatacatcatcattcctttcgttcaaatatttctgccattccttattagaagggtcgaccagataaatattacttttccatccgcccggcaaatcatgactgtctttagtagtgtgagaagcatccttaaacaaataccattcctccttcaccccgtccgtagcagcatccttcaacgccccgaaacaaagattgtaaaacatagacttcataccgaaacgatgctgcgcttcaatgtaatttttcaccgaacttgtataaacctcccggttagcgatgtccatatatacttcgtccaactgtgtgcgtgtaccgcccaacggccagtgatgtttattatgccagtcctgaaactgtacccaattgatgtgatgacgattcagatacgccatctcttcctgtgtcttttcagccgtcttctcctgactgaaatcagcgacaaaaccataacgcggaaaacgtgacggatcactggatacatctaccgcaatcgtaccgacaatcacatccgtaccattctcctgacggtacagttccgccatatatcctttgaaatcagtagtaggcggttgccatatccagctcgtaccatttaccgactcttctccgacaacctcccctaaaagacgatagcgaactttagttccggcaggcaacgcatcttctgctgtaaataccactttctcccccggtttatagaaagccttatccgtagacaggtccacacttaaatccgatgttaccggagtcacttcggtaacactgcccgaagctcctccattctcctggttcgccccatgatcgtcactgcaagccatacacagaaaagcagccacccaatatattattttcttcatcttgaattcttgttttattgtttcacaatcgaaatcgtctctttcaactggtcaatcgtaatccgataagaaccggcttcctgaatattccacttattatccaaactacccaaatctgcatccggatacatactgctcaactccgcatccgacttaacaacaaacaatgccgtctctacttctcccgtcggagccttgttgctcttatccgccataaaccaatccccgttccagtctgattgcttgtcgcaggaaatcttcatctcacctgttttcagtgtgccgctccaggtaaagatgtaaggactgtcggcactcttcgtcatcggagtagcattgcctaaatcccatccgtttggagttgcctcacccaccagatacagcccttcgtaaggagtgaacggacgcatcagcatcttttcttttcctttgcctgtatagaaccatactttataaggtttgccacattcggcttccttcatctgccatttattatcgtcacctccaagcactactgatgtcgaagtgtacggagcattagccacagtaggatggaagaaagcatccgcctgaccgaaatctgtcacagaagcgaatttaaattctccgtccgccttccagggaatcacggctccataatggaacaggttcatctgaacagcatctttagacagtgcttcaaatccccaaccattgttacccgtaaacgaaccgacaatgaaaaattcttcatatctccagccaatatcttctgtttcagtaagtgtcaacgtcaagtcgagcaggtttgcttttacgatataagttgcttctttactgattgtgaactgttcgtccggttggtcacccgatgtacgataggtcagtttgagtccttctccggcagtagcatcacggttgtacgacggcaggaattctcctaaggtcgttataaacttaaacgatccggtattcagctttcctgtccatgtaaactgtccgttatccgtgcgctccattgccgttgcgttatcggcactccatccgttcggagtagcatcaccaatcaggtaaagcgtcgtagtaaccggctggtaagtagtcaacgtaaaggcagtcgtcgcaatctgcttctgatcttccattccggcaacgacggctgtgatacgtgcttccagctctgccttcacgtcataaccgataccgaactgcgtatgcagaaattggttaagttcttccactttcttagtccattgatacgttcccgtacccaaatccaccgaataagcattcgcaaagtccgttccggctttcgccagttcaagcgtataagagatacggttaccgcttccataattcgttccggtagtccatgaaagcgccagcgcctcctgactatggttcttttcgttcaacaccaactcctgctgattcaccgaaagggtgagggtatcatgtcctttatctgtctccatataatcctcggtacaagcaaccatcgttgcgccgatgaaaagagagcataacaactgatatatatattttttcatcatattatttgtctaaatgaatgattataaaacggattaataaccgggattttgagtcatcaggtgattggagtccatctccgtttgcggaataggcaacaagagacgttctttggtcacattattcttaccgatagatttcaggaatgtcaatgcataatttccattatcaacccggatcatatcgaaccagcgatgtccctcaaaagcaagttccatccgacgttcgtgaataatcttttctctcatttcggtctgcgtcagagtggtcggcaaccctgtcagtccggcacgcttacgaacgatattcaatggttcggcagcctgatccggatgtccctgctcattcaaggcttccgctttcttcagtaagacatccgcataacgatatactacaaagttgttggggttggtattatactccggagagacggttttcgacacaaggaacttacgtacgttataacccgtattcgaccaggaacgtctgtattccataccgtcaaaagcaggacaaccctgatacaacacagtgatgtctttccgcaaatcaccgtcctcgtattgcttgacaaactcttccgtaggcaagttccatccataagcaccggctaccatacccgaattacgaggccccatgaaagtagacagccaggatgcttgattatcgccgccccagaagtcatattccgtactaccggagtattgcacttcgaagagagattctgcaccattattgatcgtcgcattaaagttatcagcataattgcattgagtcagatcatatcccattgcagcaatgttattgcacaaggtcactacttcattataatagtcgcgatggttgggagccagtgtcaggtaaatatccgccagcatcgccattgcagcctctttgcaggcacgtcccctgtcagcatctccataactgcttttcggaggaagcatattcactgcatttttgcagtcggaaagaatttgagcatatacctcatctaccgtattacgggcaatatccgcagattctcccggttcaaacggctccaagcgcaaaggcacccctccgtacaaacgaaccagaatataataataatgtgcacgcagaaaataagcctcacccatgcaacgggtctttatctcattggagacagatgctgaaggcaaattggaaagcacgatgttgcaacgtccgatccctacccacggagaacgccatacatacaaggcaaagccgttatcgctctgggcaatgaaattggaagcctgaacagtctccaaaccgtcagtacctcctccggctcctacttcactgttacctgcgatgatgtcgaggctccaaatacgctggttatacatattagatgactgaagagtcttgtagcaggcagtagtcagtgccacagcaatctcattcgtcacttccgactcgggatcgacgccatatttgggatatttatctaagaaatcgttgcacgatgtcaatgccagcacggcagacataaataccaaagttattatctttttcatattctttctcctgatttaaaagttaaagttcaagcccatactgaaggtacgtgaaatcgggtaacggctgctgtcgatgccattaatatcaacttccgggtcaaagccggaatatccggtaatagttgccacattctcgcaagagaaagagatgcgggcattttccagttgaatcttttgcatccactttttaggcagtgtatacgaaagcgtgatattcttcagacggagataggaaccgttttccacaaatctgtcggatacacggcagttctggttcgggtctccccaaatggcgcggggcatagagttgctggttccttcacccgtccagcggttcaatacggctgtggtctggttgtaagcggctgccattccttcgttgtcaacattgttggcattataaatcttgtttcccgatacgccttgcaggaaaacggagagttcccatcccttataagagaaattattgcttaaagagaagaaccagttcggattcgggttaccgataacggtacggtcttcatcgttgatgactccatcgttattcaaatcccggaaacggatatcccccggagctgctcccggttgggtggcatggcggtttacttcctcccagttttggaaaagtccgtcggtcacgtatccgtagaatacattgatcggataaccggctctaagcatagtcacgtatgagttacccatctgattgataaacatcggagtttcgctgttcaggtccagaatttcattcttgttataggtagccgttaaagcagattcccaagagaaaagacctttcaggttgatggtgcgcagggtcatttccactcctttgttgcgcatcttgccggcattggtaaaggtttcagtagtatcttcaaaaccggaggtgatagggatggaagctttcaccaacatgtctgccgtctttttgatgtaggcatccagcgaaaggttgacacgtgaattgaacaggctcatatccacaccgaagttggtttggcgtacctcttcccaatgaatattcggattggaaagggtggtagataccaaagcggtggagttgttgttgccgaaaggatagactcctgtattataggaagccacaaagccgtagttaccgatttcctgattaccggtcacaccgtatccaatacgcagtttgaggtcattcaccggagagttgtctttcggaaaccattcttcctgcgaaatacgccatgccagagaaacggaagggaatgttccccaacggttgttcttaccgaagcgggaggaaccgtcacggcgcacagtggctgtaagcaggtatttatcttcgtaagaatagttgagacgtgccatcagagaaagcagtgcccagtcgctctggctgccaccgatactgtacatcttctcgccgttgtccatttcatggatattatcaaacatgaagatattcttttgagcattcaggtaatcatagttgttccactgggcggaagaacctgccatcacacctacacgatgtttttgggcgaaagtatggtcgaatacaaaataattatcccacaggtaggtaaatgatttgttgtcactcttatagcgggaagattcttctaccggattcggtttccagtcgtaagccggagtaaagttgtcgacaaaccagaatttggcatcataaccaaaggtacttttcaacttcaaccatttggtaaaggcaatctctccggtgatgtttgccagaaagttatatccttttgtctcgttcgtcatcatatacaacgtaccgatcggattgcggacacttccataccattgcgcttcctgtccgggaccgctccagccaccgtcttcattcttcaccggctgggtgggaagtgctttcatcgcatctccgatgctatagcttcctccctctttcacgtccgtactgaatgtcagattggtagtgaacttcaaccatttattgacctgggcatcactatttgcctggaaattgaaacgacggtaattaacgctttccacgataccggactggtcgaggaaaccgccggatacatagtaatgtgccttttccgtaccgccggaatagctaaccgaatagctttgtttcactcccgtacgtagcatctcatccagccagttcgttcctgttcccaataaagaaggatctgcccaataagggtttgtattatcatcattattagacagcatatcattgctcaaagcggcatattgcgcagcattcagcatatcgggcactttagtagcgttctgaatagcccagtttgcgtttaccgttacttttccggcaccctcggcaccacgtttgctggtaatcatcaccacaccgttggcaccacgggaaccatagatagctgttgccgaagcatccttcaatacgtctacccgttccacatcagccatattcaaagaagacaatcccaagtcggtaggaattccgtcaatgacaatcagcgggttactgttgttgatcgtacccaaaccgcgaattttaatagtgacattatcacccggcttaccggcatcgattatctgcacgccggatacttttccctgcattgcctgaccgatattagctaccggagagtctttgatgtccttcactccgacagaagatacggcaccagtcaaatcgctctttttcattgttccgtaacctaccactactacttcgtccaatacttccgtatcttcctgcaaggttactttcaacgagtttttcccgttcaccggaactgtctgcgttttatagccgacaaaagagatagtcagcgtgctgttagccggaacgcttaatgagaaattaccgtctacatcggttatcgtaccattcgttgtacgtccttccaccacactggcaccgatcaccggttcacccgtggcatctactacatgtccttttattgaaatctgttgtgcgaatgcactaagagataggaacaagccccacattattaataagaggcggcgttcaaagcctttcgacttcatactctgtttcatgtacattaatttaaagttaatattagggttacttttgttttcgttctctgtgtcattgctgaatgaccgtgaaacaaaagtatccacatttcatactgcttcttaaagcagatagcaaaaatatagtgatttatacagtatctcacagcataaaccactaaatataagaacgttataaaatagaagtcagactaaaaaagtagtgattttcttattcttccaccttccctatttgcattactttagtctcaaattcatctctttctcccaaagctttgttacggacacgggtccggtaattataaatggtagtcacggaataacggaggaattgcgctatcttggtactgtccgtaatccccagccggataagggcaaatatacggagttcggtgttcaacagttctcccggtttgggttgcatgggttcggtaagcagcgcattaaattcttccacaaaattggggaagagttgcaggaaagtcatgtcgaaatttgcataaaaactctttcagttcttcgtcaaggaattgagaagatttaatggctttatatagttcttccactcttccggcagcggcaattttatttagggaacgacggtataaatccatcttgtcgagataagtggagcattggtccatatatcggccgatatattcctccttgatatagttggcttccgaaagcgtatggttcatctctttcagttgcgaattggagtcgtgaagttcttcgttcagttcttgcaacaacgtattagtatcaaccacttcgcgacgtgcggcagcaacctttttcatctgcttgtaaacgaagaaaatggcaaccaacaaaaatacggaaagcaaactgatacaaatcaatgatactttcatctcctgttgctgccgtttggttttcaattggtaagcctggtcaatgataggaaagacttgcgagatttctaacgtacgaaggcgggcattacaaagagtggcatcctctaaggagcatttcaggtaattgtaggcacggtcaatatccccttcatcgtagacaagagaagcgagtttgcgcaaagatacatattcctttactgccgatttcaggtcggcaatggccgaaagagccaggtaatgtttttgcccctgtttgtcgcctttcaaccggtaaccctcggagagagtataagtaagcattgcttttgaatggtcatccaaagaaggtttgttgtaatattccatcagcatacggatggcttcatcgtattgagcatgtacgatacacttatccgccatcaccaacacgtgccccaaagagtcggaagcgttgacctgcagaagagagtcacgatacagatccgtcattcgataatactctttcttgactttctccgtaacggcataatctcccatcaatccgtaaatagtgcgatacagatgataatagtaaccatagagataatcgggcaacgttttcttatcaatctgccccaatagttccaacgcttctttatacattccggtagttcccatcacttccgccatattcatggcagcatcatccaggtaatccagtttatccatgcgatgcgccagttcctctttccgttgagcatagacaaaagacgaatccagattataagcccggtattcatcgaaaagacgtccgcaaaaaccatatcgttgttcatcggaagtagcctccgccaacaatttcttcaggtcagcgatacgcgcctccttttctgctccataggtctgacggtttttaatgataccatcaatctcacgaagtaacgcatcggtactcttattatcttttgcataaagcagaccggaaaggacgattgtcacaaaaatcagaatcacttttttcatagtgccgtatgtattatagttgcaaagataaaagtctttcagaaacttccggctttcaggagaaaattattgcaggcagaaaaacaatgtttattaaaaagaggaggtaaatcggatttattataaacataattattatatttgtaataattgtatttataataatcagtatggcaatcgttaataacccttttatcgtaggcggatacctatctccccattacttttgtgaccgcgaagtggaaacagaacagttgatacgtaacataaccaatggaagaaatgtcgttatcatttctgtgcgtcgcatgggaaagacaggtctgattcgtcattgcttttatcaggatgagattaaagagcattactatacattcttcattgatatttatgcgacagccagccttagggaatttgtattcgctttgggaaaagagattttcgagaagctcaaacccaaaggaataaagttcatcgaacgtttcttctccgtcatttcctcactgcgcgcaggttttaaactggattctgttacgggagaacccaccttcgatattggattaggagacattcatactgcagaaacaacactggatgaaatcttcgcttatttagaacaggctgataaaccttgtatcgtagccatcgacgaatttcagcaaataggcaattacacagagaagaatgtagaagccatattgagaactaaagtccagcattgccaaaatgctcgtttcatctttgccggaagccagaaacacattatgatgaatatgttcaacagcccggcccgacctttttatcaaagtgtcaatatgatgcaactaaagagcattccgcttacggcatacagggcatttgttgaaaggcttttccttgaaaataagaaacgtattgaagaagaactgatagacgaagtatataatttctttgaaggacatacctggtatgtacaactcatgtttaatgaattatatatactgaccggaaaaggggaagtgtgtgatcgttccctccaaagtattgccctgaccaatatcctgcagatgcaggacttcacatatcaggagattttctcccgccttccggaaaaacagaaagaagtactgattgctatcggaaaagaacaaaaagcaaccggagtcacttcaggaaaatttataaaaaaatacaagctaagtactccgagttccgtacaagctgcactcaagggattactggaaaagaatctagtctcgcaggaacaaaatcagtatgaaatagctgataaactgttgggagtctggttacaaaagaattattagactataaatcctagaaatgaatagttaagaataaggtttcattcatttttggtacggttattagcaaagcatctccattatcaacattatttggctaatgacataaaaacgcaagagggtttatattcatcactctggtgcgtcaacatccccaactttctttccctttctttgttctttctgcgggaatatgctacttttgcattatctcataaatatgagaactaaagaaaggaacaaattatggaagaagtaaaaagaatcccttacggagtttccaactttgtggaagtggtggaacagaatcaatattacgtggataagactatgtatctgccgttgttggaaaaacaacctagtaatttgttctttatccgcccccgccgtttcggcaagagcatctttctgagtatgctccgaacttattatgacatcgctcaaaaagaaaagttcgaaaaacgtttcagcaatttatggataggcagtcgtcctacacagttgcaagggactttccaaatactctttcttgatttctccagagtgggagggcttgacagaacgcttgccgaaaactttgatgattactgttgcggcggactggatgattttgcttctatctatgaaccctattattatcccggctttgaagaggaaatgaaagcccaatacggcactaccaacaaactgaatttcctcgatcgcaaggcacgcaacaacggctccaagctttatctgatagtggatgaatatgataatttcacgaatgtggtgctaaacgagcaaggcgacaaagtctatcacgccctaacccacgccagtggtttctaccgcgaaatcttcaagaagttcaaaggcatgttcgaacgcatcttcatgaccggagtcagccccgtaacgctggacgacctgactagcggattcaatatcggctggaatatcagcaccgatcatcagtttaatatgatgttgggattcagcgagaccgatgtacgcgagatgatccaatactataaggatgccggacagttgccgggcaatacgaacatagatgcgatgatagaggaaatgcgaccgtggtatgacaattattgttttgccgaagaaagcttggagcgtgacccgaagatgttcaactgtgacatggtgttttattatctgcgtcattatatgactttgggcaaatcccccaaagaaatgatagaccccaatacccgcacggactataataagatgaaaaaacttatccggctggacaaattggacggtaaccgcaaaggagtgttacgtaaaatcaccgaagatgggcagattgtcaccacgttgacaactacctttcccgctaccgatattaccaaacctgagattttccccagtctgcttttttattatggtatgcttaccattactgccactcgcggcaactatctggtgttaagtattcccaataataacgtgcgtaaacagtattacgaattcttgttggaagaatatcaggacaatcgacatattaatctgaacgaccttggcctgatgtattacgaaatggcttacgacggccattggcgtgaaacgctggaatttatcgcccatgcctacaaggaaaactcttccgtgcgcaacgctattgagggagagcgcaacctgcaaggcttctttactgcttacctgagtacgaatgcatattacctgatagccccggaagtagaattgaaccacggttattgtgatctgttcctaatgcccgacctgatacgctatgacgtgaagcacagttatatcatcgaactaaaatatctctctgtcaaagactcggaagcgaaagccgaagcccaatggaaagaagctgtagagcagataaaaggttatgctgccggtcccaaggtacgcaggatgatatacgacaccgagttgcattgcatcgtcatgcagtttcgcggatgggagttggaacggatggaagaagtcagatagaaactctgcctgatataattattctgaatacacaaattttcatttctcatagtgtctttccagtcaacctataacaagaataaaaaaacaactagtcaaccattatcagggaagtacatattctttttgtcccatatattgtgggaaagtattccctactaactgggaaaagattccctcattttgtgggaacaaattcccataatatgaggaaatactttcccacaatatatgggacgatcggaactagtttatctccaactagaaaaaggaagaagacagtatcttgactatgagaaataccttgaaatactatgagaacaaggtgaattttaagctaaaatagagggtacgttatgagaaataccatattagaaagtatttctcataagctacttatttgattctttgttgtttatcagtcatcaatgagaatatgagaaataaaaatgaaaaatcgtggttcttaatcaaattccgtgctagtaaagctcattgaaaggccgatggataaagggatatcggcatattagaaataacaaataaattatccaaactatatgcatcttaaagtactccagaatagccatgaataaggtaattgaacataaataagtagcacggaatttgattaagaaccaaatcgtttgcagagcttgctgaatttttaattgatgtactcatgactgcaccgttcttagttaaatggaaatttaggggcgctatgcccctaaatttccatgttggagttggcatttgcctcatttccagacctttgtaaaccaattcaattttattcttttgattctcatacaccacttttttaaccggcatttataacagttgaactgtcctaattcaagttctatttctaaatcccgtacccgttcgttttgttccatccacatgccccgtaacgcatctcgctgtgatttggcttccctatacatttcaagctctttgtcgcgtgcccctaagaggaaagcatatatcaagcacgtctcggatttactgatacagaattgttccaatgctttcacatattccggatcaatgcctttctccctggttttcaggaatccacggagactttcatcgtttacaaccgttttgtaatccttgaaatatgacatgattacccgcatatccacccaaagttggatatattcttttttaagattgtatttcttagccgcttcttctacgctaatccattctgacataatgttcgtttttttatgtgtgatacaatgaaagagggatactctttttattatattagtgcaacgggcatctacgcttcctgcagtccggtgggcggggattggttaggttatattggggtattatgaataaaccgaccggatacaagaaaggcgcagatgctgttgcaccattatccgctcatgaggcttagcaagacctttccaaaggataatgataacaacagacacccacgccaatcgtttatatataacacattcctgacggatatgttgatatacaccgttcgcgtggagtatctgctgaatcatctctctttggtcgaaagttgctaattttcatgagcgagagataatacgcttttactccaataagagataaaaccactttccaccagttccatcacgctgatgggcagaaagcgtgtgacaaagataaatgatttatttggaatatattggaaataaggtaataaataataaaaggtacataccttacaatagaaacagacaaaagaaaaacaattctgttaataagccctcaacccataatcgaatctcatcttcttgctatctttcacttcaattttcaacaaattacttccttttcgcaagtaacggctgtaatcgctgatattatattgattatattgcctggtctgctttgcctcctgcgcaaagacttccactccattcagccaaactttggcttctccggcaacattcagccataaagacagataattgaaatccttatccaccttaaaagtagcttctgatactaccgtagaacgagggggacagtcgaaaggcaaagaagtcattttcagctcctgaccgttcagactgacaaggcgggtattcttgcttccattctgaccgtctgcaatcaaagtaacagctttcgcaggggtgatttcatacaaacggttgtgcatcaggtgtaacaagccttccggtattttagttactttccggtcgtaagtaatcaggccgttcacttctccttccacatcagtggtttgtgtataaacagccgcactcaacccttgggcaatcagcgtttccaaatcatataccagacggccgtaactatcaatcagagccattgctccgtctatattcttatacccccagttcctcatattcggattccagatatgttccttgatcgcccagccatagccgccgaattctcccagtacggaaatgcggttaccgttgttctccggcagaatcatggaagtgacaggataattatgtacgtcgtacatatcgcctacgcctctgtccgtccagccggtcactccgtttatcaggcgtgtatcgtcgtattttatcactttatttacgatttccaccgtgttgtgctgtccccatccttcattgaaaaccacccaggtagtgatacagggatagaaacggagacggtcgatcatctcgaacatttctttttgccattggcgggtgtgttcttcgggggcgttccaatcagtagtagccaacggattgacgtgttcctccttcttccttgacgtagcaaaaccggaaaccatgtcttgccacatcatcaatcccaaggaatcggcgtaataataatattgctccggttctactttgatatgtttacggatcatattgaatcccatcttcttcaactgcaccatgtcccacagcatcgcttcctcggaaggaggagtcaacaatccgtcgggccaccagccttgatccagcggaccgtattggaagatgggttggttattcaggcaaatacggttatatccgcactcatctttacggacatctacttttctcaaggcaaagtaactctttacccggtctaaaacacgtcctccattggacaagacaatattcaaatgatacagtttcggagattcgggagaccataagacagcgttcggaacgtctatctctatcgcattagtcaacttctgttccaccgtcttgattactttgccatcatccaacacttctattttcacttcttcattgcctttggctccgattatatcgaaagccagcttcacggattttctttcaatatcagtggaaggaagtacctgacggatataggttttattcaccgcttccagccacacagtttgccaaatgcccgatacaggcgtataccagataccttcctgattaagttgctgtttccctcgggagatcgattccgtatccgtcgggtcggtgacggctacttcaatgctttgagggccactcttcttcaggtatttagtaatatcgaacgagaacgggttgtttcctcctttatgtgtaccgaccaaccggttattcacccatacttgacattcataatccactgctccgaaatgcagaatagcagatttattcttccaggaaggatctaaggagaactcacgttgataccatagtttatccgtaggaagaaatgttttctgcactccggacagagatgattcaatcgcaaacgggaccaggatttccccttcaaaggaaacattcttccgggacgtgttctgatccgttacggcatacttccacaatccattcagattgatccattctgcccgttgcaactgtggtctgggataactttgccacacattttccggcgtcacctgttcagcccatactgttttaattttatctcctttaggctcccatgcatgggtaaacacctgcgacatggctcctaaagccagagttagtaagattctcttatccataagcattagcgggttttatattctttaaaatctttccgtcgattcttattgtaggtattccacattttctggaaatacaaaacatcactcttgtccgcccattcgaaataggctgtttccaattcttttgccatttcaggatatttaccgatcaggttgtgctgttcggtacggtcttccttgatgttgtacaattcccattcatctcccttgaagttggcggaaaccagcttccagtcacctttacgcaccatgcggttgccttcatgctcggcataaatatatctttcgggcatcttctttcctttcacaatcggaaggatagactgacctgccgtaggcagaatcgctcttccctgatattctttcggataagtggctcctgccagttccacacaggtagacatgatatcggagaattgtgcaggctgatgattcagtccgcctttgttcttcacatgattaccccaggaaatgatacacggagtggaaatacctccttcgtgtgcataatgtttatagagcgtgaacggcgtgcagcaaacatttgcccagcctgtaccgtaatgatgataggttccgggcaaacccatttggtcgagttcttctccggtatgggtatggtattcgactccggtctgtttgtcgaaaccgaattcgtgccattcggcacaagctccgttatcggacataaacatgataaacgtattgtccaactcaccgtttttcttcaattcatccactacccggccgatgttcgcgtccatcacatctaccatagcggcaaaaatggacatacggcgtgcgaggtcggtctgctgatctttcgtcaatgaatcccatgccggtagcggatgcgtttcatcttcaaacagactttcgggaactacaccacgcggactaagtgccggctttccctgcataagtttcaggtccacaatccgtttccagcgggcgtcacgaatcttgtcccatccctgcatatagagagacatatatttatcggtcacttctttcggtgcgtgcaaagggaaatggggagcgttataggccagatacaggaacaacggtttcttctcctgatgtgcctggtcgataaagtcaatcgcataatccgttatcacattggtagcgtagaaagttccttcctcatagtgtctgggcgtacggtctttcggcaaacgggtatatactgccggattccagaaagagttgaatccgcccaacaaaccgtaatactcctggaaaccacgaagaataggattcgacttattccccaaatgccactttcctgacatagccgtaaaatatccggcatctttcaggacttctgcaatcgtgacgttgtccgaattggaacggaaaccggaatatcctttcggccaggcaggatgactgccgtccatgtgtcccaatcccgtctgatgcggataaagtcccgtcaacaggttggcacgcgacgggcaactacgggcactgttgtacatctgcgtcatacggacgccattctttgccagtttatccagtaccggtgtatgaatctcaccaccgaaacagccgagatcggagaagcccaaatcgtctgccagtatgataataatattcggcttgtcctgcgcatacgtcatcgggaccagagccaggctgcctgctatcaataaagaagttttcatttggtattataattaaagttgggtttgaatttaccattctcatagatcatcggaattaatccgggacggcacgtcactttatactctgccgcctgtgccccacgcggattgaagaacatggtagcccaccagtttccatccttatcctggaaaagattgttgtgtcctcctcccgtgatggcattgtagcgttcgctatagggaccatacacattatcggcggtcgagatgatgcagtcgtaactataacgtgtcttcggtgaggttactccctttttctcaatataggtatctccctccgacgtacggtgcgaccatatagcttgtacgaggtgatatttgttatcgtatttgaagataaacgctccttcaatatatggttccggattatattttttctctttcaatgttttcagttcctcggcaaatccgctcatatccggtttcatacgggcgatataatggttgtgcccgacaaagtagacagtgccgtccgtatcttcgaacaaacttccgtcgatgttcgggaagatagctttatctttattaccttcgatattctcgtacggtccttccggctttccggtcttgctccgcaaaatgaaagaacctctcccacctgccgactcattcatgcaggcaacgataaaccagttcttcacacttttgatataatgcatttccggagcccatacagcatggaaacggttgtccatcggatcaccgttgatagatttcttctgatatttctctcctgctttatatactttcggctttttttgccaggttccgtctttttccatcgaccatatttgtcctctggcttcccaggacttcatatctttggaacgccacagatacaaaccgtcgttccagtcccagcaatgcctctgtcccggaaagtaacggtcgggggtagaggtcgttcctgtgatataataataaccgtcgggacccagcgtagcccaagtgtccctcatccaataatcaaatgccggctttacagatgtcggaacacgtagttccggagcgtttgtatctgccgttccatataactgtgctgatgctgtagagatggaaataaatcctgtaaacaagatcaatcctaatcgcaaaatcaatttcatatatttctgttttatgtttacggatacaaaaataggccgttgcggggcagacttcatggaatcatgtttttaatatccgtaggtatgtacaatcttcttattttttagtgttccgggtggagataattaaatggattctgtttaaaatggtaacgtctttgcgggagaggcagcggatcctgcaaacgcaactcccatgccagtaaacgggtcagaagttctgtttgaatttcgcagtatttcttctcgccaaacagattatgaacttccgaaggatctttctttaaattatagagttctccgttgccataatgattcataaccagtttccagtcatcctttcttatcatgcgtgaggtaccgctttgcgtccaggtgttcagttcgtcgaagtgggctattttgccggaagtcaatgctccttcctgttcaaaagtcaaggaggcatccagtccgacatcggctcctccgaagccttgctgtacgaccatgctggagaattcttctttagggtaagcttttccggtcagcatcggccacaagctacgaccctgaactcctgccggtatttcggcaccgatggcagagcagaaggtggggaaaaggtcggctatcgatacgtggctatccataggggcaggctggttcttaatgtgatatcctgcccataccatcgggatacgtgcgaggctttcggaaagtccggctcctttacgaatcaatccgtattccccccagtagtcaccgtggtcggaaagtacgacaaagagggtgttttcatattgtccgctggctttcaatgattcgatcagtctcttgatctgatcgtctatcaaccggatcattccgatatagttggcacggattcgaggcaagtcttgttccaggttcgggcaggacgcgtcttccagttgcgccaaaatacggtatttctctcctttctttgccaaatctttgcgggaggtctttaagacgggaagcttatcgggggagaacatggagtaatagggttcacatacctgataagggttgtgaggttccggaaaagaaacccatacgaagaaaggattttctttctgctgcttaatccatgccagtgcttcgttcacgattttggtgggatgctgttcttccagcgagatgggagatggctccaaccattgccccctggcttgctgattcaggaaacgggcagtctccttctctgcgggagtcgtctttttgtgctttccccagtgtccgtattcagaccagaaatcaaggtcggcaggtttcaggtaagcgtgattcttgccgaccaatgctgttttatatccgttttctttcaatacgcccactaagtcctgttgataggaaatgtcaggaatattatgattcgtgcgtacgtgagtggcggaaggaaaacgcccggtgaacatggaacaacgtgccggagagctagctggcatcacagtgtatgccttattgaaccatacattctcttgtgccaaccggtcgacaaagggagtcacttccagcggaaaaccttccctgccgcacaaatcggcacgctgctgatcggtcataataaccacaatattcggtttgccggtttgtgcctgggctgatattgtcaaaccttgtatggcaagccctgtgatacaaaagattgctttcattttattaatttgctatttgacgattaaaaaactgtcttgacttatatctcggaatagtaaatgataattttgcggagtgccctgaaagggcttaattatatagcgtagggcaacgccctacgtaaaaacgacaatctgaatttgcgccctgaaagggcataattgtatacagttccgccctttcagggcttgtggctggtgtgtttttttcgtagggtctttcaagttcttgcgctgccttgtattcgcgactgccttctattaccatattccaaatatttaagaggtttataaatagaaagagtacctatatatagtatatagatacccttattagttcttcatgtactacttcattgtaataatcttgtatatagtccaaataatcatcaagaagaatacaacaggtgaaattgcacacataacaagtaacaagataatccaagatataacgactaataacgcttgtaacataatcttttgaatattaataggtaatgaataatcaagggacacccttattatatggatgccccttttaagtactctgtaataccactaactaagaaaccactgatatttgtcatcaccatgtaaagcggaacatatacccgttgcaagttctgtagcattataggctctatccaagaatgaatctatatagctactcttatttgcacctgtgagtaagttgtagaacttccacatagacaaatcattccccaaactgccaaagttctcgtcattgatatacgctttagccacattgttaacctgtgtatcagtaagcaacattttaggtatatctttctgatagccttgcggtaatgactgataaagtctcattcttccaagtagttggcagaactgatgctccgtcatactggtattgcctaaagactgcatcaaatgtatgtgtttggctgcatcgtatttgtggaacatttccaataccgcttgatataaatcccttgtattggtaacttccaagcaactaagataaccgtctgtagatacacatagatttgtgcaaaccttacaagtaaagccaataaacactttaaaacgctccgcacctttctttgaatacagattggtatggttataagctctgacaccaccaatagtaagtgttagcctgttaccgtgtactgtctcatagatagtaggaacttcaataacaaaagcgcatctttcgtagtagatagtcttgtcactctctagtaactgattggctggcttatgaattgcttcgggaatcctacctttgattacatgagaaacacgaatatctggcgattcaatttgttcaccgctaaagaatgtattggttgcatcctgtaccgcttcaatgaaagccacatgagataatgtagcttcgttgtcctttgcgaatacgggtataatacaatcattccttagatgctccaaactggcttcaatcgtattggcttcaatgaatagaggtcgtttctgcttaataattggctcttcaattattaccgcttcttctgcatattcaccaaagtttctactagttctctgtactggcataatctgtaatgttgattccataatctgtaatttattaagttaatattagaaattcctctgtctgaaagccaagcaagccacaatcagtattaataatccaataaagaactgtggcactaagactactggcacaattagaattattccaaacgtcaataaaatctttaaattctccatacgcataataatagattagtaaatagtgtatttaaggacaaaatgagggcttaacatgaagtactattcattcactttcctttgtgcatctttatatgtagacatatacaaatcattgataagtccgcacatttcagaagttcaaaaggtttgtgggctgaatggcaattcatgctatcctttcatttttcctaatgattggtgaggggtgttttgggtaatagaaggggcttatgcacgatatacatctgatgcgctcactgacaaatcaaatatttcactctatcactgcataaagtctaaatagaaacacgacctaaatctaaaggggcgggggtatgattttaagtacctatatttttgagttgggaatatacataaaaagccccaaacctgattaatggtctggagctttattgcttacaaactaactacagaataatctcataaggtatatcttccttaacaggtcgctttcttcctactgtacctgcttgtattgacttcataaaagcgtggatattcctgacatctttaaatccattctccttatacttcttataaatcatacattctctggataatggtttgttattgccttcgttgaagtctatcatgtggtcgaacatggcaattagtttctttacttgcttatctttaggctggtctattattaagcctttgacctttagaatcagacagtcaccaatttcatccaataaatccaaatcctttaactgctctatataccgactaatagtgctatgtcccatgtgaatatacttctccaatttccttatggatgataatttgataacatggctatgcggctctgttacactgaatagttttaatatgaatcctcttagcttcaaatctaaagtattgtaagtatcgtagaactctctgccaattcttctataattgcctagctctacttggttgaatctgtacatagtccaatgtctgtccttctgtttggaatctatatcacgtataacaacctcgcctgtagcccttaatttgtcattgaaggataatgtactcttactcttcttgtaattatccagttcttcccctacaaaccctgcaagctgttttaatgtagtattagtttccaaagaatctttatctgctgtcagtagcaaggtataagtcctatacacatctgaacagtttagattctgaatcagattattactcattactgtgtactccttgaatggaagtttcgtgtctttcataaggcaaacgctcaatatggttaatcaaaataatctgattggtctttaacaagaatctcatcttagtggaacttagtctgttcactttccttagttcgcttagtttctcatataaattattattataatgccacatatattattgatttatatatcctacttatcccacctactgaaagttcgtcagaactttacagtatggctgtatggagtgtagtatctaggagtgtagacagggggtgaataagcacgctccaaaaggggattaagcacaccgctaaagggggaataagcacacctttataatctggtaatatcaatacttctgcacataactttgctgtattagtaagcacattagtagatagtgatactaattagatgattagttgcaaatacataccctgtctagtatgctcacttattaacggtaaaagggagaaccagtaatactgtcctcccttcattagaaactattcatgtatcattgttcatcttgatgtaaacggtgtaaaccttgttatctctctgcttgcgtctcttggaatatccattgagcttagcccatattccaatcatcgttctattatctgctatatggtgggctaatgcaagctcacgtaactgtttgaatgtaagttctgtttcctcactcattcttagtaccatgaataattattaaataggtaatctggcaagataaggtggattgaatcggtaggtatattcagatatgtttcaagtgggtaatttagtagtttcagtgataccacccttatctcatgttggtagtgcaaagatactgcacttcggtgaggtgccaaaacgcttcgtaaactttcttaaaactttatgttgagagccttatgaagtgaagatatgctcttttctgctagcttggaaactgattcggaacttgaaaacgaatcttgctctgatttacggtgtgcaggtgaacagtgcacgtcttgccttgaattatttttcacttctgggcgtatcagtcggcagttcaaagcccgatgtaaattattgtgtctctgatatgtcacagtctcaaattccaagtgccggataggtcagcccactcatttgaaacgaattagatttatggtggcaagtctggaagataaacggagcggtcatttcaagattgacaagccgtagggaatgttagcgttgcgtattcacctctccgctctcgtccgcatggataaacacacgtgagagtgcttgcagccatgaatctccgaaaaatgagacagaaccgttcggagtgtaataagtcaaactctcaacagttctgtcccacttgcgttcaccttattggatatttacagtatgacaacaggcaaattctagttataaagacattgatagaatgtatatagattactacagtctattagtatgctgtattactataagatactgtggtattataaagtattataactactatgaatatatacctaattccatactatcattcacgaccattatgatatatatctacaataacacattaatttatagcataaattatattagacttgattgcttatttaaaatatatttgtacatttgtggcgtttcatttagagataccataatggcttaattgcgctttatgttcgtttacttgtaaacaacttatggactaataccgtaaggaacggcaagcctttgagtagatttaaaggttaatttatttaccctaattaatttatcattatggagaatcagaatgaagcaacttgtgtagtgttaagtcgtgaagaattatttgatttgtatggctcttggtttggtaatactgcaacaccggctgatatggtttgttggtgtgacaggcaaatcgagaagtacgaggaatggattaagaactgcaaggaactcaaattagagaaccagaagaagcttcttaaagatattccaacagacatactacaagctattttagattcttctactaattaatactactaagtaaacactttagggtatccatttggataccctttctagttaatagtaataggttatgctgtacacaaaagtccttgatgaatataagatagattatgaagaatatctccgagaaagggaagtagacttcttcggaatgaaggatagatacctaaagtatatacagaccaaaggaatagaccatttcacttttaaacctataaaaattactaccaacacaggtcatatatatattatcagatatagctttaatgcatactggaagcataagtttataccattaattgcaagatgttaccgccaaccggaaggcatatatgtagtgacctgtcctagcaccattattaaaataggtaagaacggtgcatatataccacatttctttgatagatatagagataggattcttaaacgtaaacatggcaataaactagatgttataatgaaattcttcgagaatgaagcgcgtttcagtgtaggagcaatgatacggtatgacaaatatcccgataactacatattcgtttttgataaattcataacactaggtagtccactagaggatgttaatatatttgagatgagaactttaatcagcttagatatgctaaaggaagtgcagaaggatatatgtaatgaacttgtagaatccaatattaaaggattagaagaacatattaaagatgaggataggaataaagatgaacttcttcgcactttattagagctacccaattataaagaagtatagcatacataatcagaatcaaacataatcttgctatattatctcacataatataagacatatatggggaacttagatttcgttgctattgatttggaaacagctacttctcatagaaactctatctgtgaaattggtattgtaaagaactctatagtaattgagagtaaactaatactaggttgaaattgtgaatattggagttgagagggtgctctaggtcggaatttacttttcttcttcaaaggagacggcaggaattgagatgagaggctgaccgattgtgaggctttgttgggcttgcatcagtgcggaaactgaattttactggattgaatggttactctgtctgattaaatggttgatatataacaatatacaatagttaaatagttttgagaatagttcatctaaaaaaagcaccccattatgtgccagactgatttctccgggttgtggaaaactacctccgccaaccatcgccacttgggaaattgtgtggtgcgggtcgcggaatgggcgttgggaaatcaatgaggacccgcgttttagttgtccggcaactgaatgtatcttggtggtttctaaactttcgcctagtgaaagaggaggaagaatggaaggaaggcgtttggccatcatcgatttaccgctacccggagcacctaccattatcaaattatgtcctccggctgctgcaacttctagtgccctttttacattctcttgccctttaacgtctgcaaaatccaagtcacagttcgtctgttgttgatagaattcttcccgtgtattaacaacagtcggctctaattcgcgttcattattgaagaattcgacgacctccttgatattactgactccgtatacttttaattgattgacaacggccgcttcccgtgcgttttgttgggggatgattagtccttcgaaaccatcttcgcgcgctttgatagcaatgggaagcgcacctttgataggttgtatacttccgtccagacttagttcgcccattaacaaatagcgggaaaacttctcggaagagattgtttcgttagctcctaacaatccgatggcaagaggcaagtcataagctgaaccctctttacggatgtcggctggtgccatattgactactatattgctagtgggcattttataaccattcaccagcaatgcggagataatacgttgatggctttctttgaccgcagaatccggaaggccgacgagatagaacatacagctgcgcgagctgttgacttcgattgtgatgagtgttgcatcaatcccttgaacagccgctccgaatactttaattaacacgtttgattattgattattttttcttcttattgtcttgtttttccttttcttcagcagcagtgactacttcctcaattttcttctttaattgttctcctttgaggtttttcgcgagaatcttaccgtctgccgacagaagaatgttgctgggaacttgcttgatggcgtattgtttggctacttcggaatttagtccgccaaaatcacagacttgctcccaattgagcgtatcacgttttatagcatcctgccattcttgtttatctatatcaagggagataccgagcatggctatatgtttgttcttcttatatttttgatagatctcttttaactcggtattgctttggtgattggaaatgctatctccccatgaagcccaaaagttgattaacaggttctttttcttgaaatcttctgatgaccgggtaattttctctccttttatattagatagactgaaaaagggggcatatttgcctgtccctgttttctctgacagagagatggcttcgttgagctgttcaatatacagcttgtcttgcaatattcctgtcatgatttcaattagcttctttattttgttgaaatcgggcgaatctttctgaacaaagtatttatccaacaagtagaggctgacaaaagaagaatgatgcttcatgatgaattcttctgctttttgctctaaatctttctcggatggggtaggcaggctatttagttctttctgaaagtttgtaaactcttcattatatatattaccattgatatccagatattccgggtgattgacatctccttttattttgatttgatttcctttgtcaaggaagattggatattctgtctgattgtcaataagtaaaaaggcagaagtaatggtgtctattgaagctgtataagagaatttatcgttcttcgcgaaaatggtatctatccggtcgaatgattcgtccattccatacagataaagcgtatctgtgcccagacctttgatttccccggttatgctaaccttctttgaagatttaccacaactgcatagacaaatgattatgaggattaaaatgctactctttttcattgctttgatttcttttctgcgaaagtacggtttttacagataaaaaaaaagaattgcccgtcatttataatgacaggcaattcttaatatttaaaatagagtggtaattctcttatttaatgatgttcatgaaatctgcatttgtgaagaatttagcaaattccaagtcagtagctgctttcttagctaatgaagaatctttagcaactgcgctcttcaagctgcttgttaccatagaagaattattagttctagcgcctaaaactgccatcaggtagtcagtgtaagcatcaggtctttctacgttagccaacgtgtttttagctttgttatagtccttagcaaggatttgagccaaagcagcactgttagtcttagagtcaccgaatgagtttactgctctttcatattgaccttgagcgatgtacaggttacccatagattcgccaagttcttttgtgccggcagctttaccgaagtatgcttctgcagcagctttgtcacccttcatcaaagagatcaaacctaagttcatgttaacttcaggagtagcattaacgctggcagctttcttgaagtaagattctgctttgtcaatgttaccagcctggtaagctaatttacctaagttgttgtaaccacggtaatcgttcgggaactgtttggtagcttgagtgtagataacttcttgcttagcaggatcgctagtcagtgtagcagcatacagcaattcttctacgttcagttcagaaggattagaagaagccaacttagcgatttcttcgtcagacttaccgatgatttcatagttcaaagtcaaacgagaacgacgcaattgaggaagaatagtgttagccaattctttgtatacagcagagatgtttttgatttcgctttctctttgagcaggatcttggtacattgcaataacgcggagaatcaactctttgtcttggatgttagatttagaaaccagttcttggaaaccttcccagtcctgtgcagtatatttagcatcgattggagcatcgatttttgctttcttcaggtctttgctcaacattttagttgtgttgccttcacggttttcagcaagagtagtattcaagcttacaccaccatcaggagaagcgtatgcagaaacttcgatgttgctgatcttcttgttagcagcttcgttgacgttagctacttctttgttgaattctttagcagtcttcaattcgctggaacgaatgttagcttgttggatcaagaacatgatgttggcatcgtgtttttctttgatgatacgttggaaagcgtcttcgcccaatgcagggttagcgttacctaatgtattgtttactaattcagaagtagagattacaccatcagctattttcacagcaggaatagtcaccactttctttccgatagtagctttgaattccagatacaattctgacttagccatttcaggaacatagtcaaaagaagttttcatcgtgtagctaccgcccatcttgtaagagatagtctggtcgttaccttccactttttcaccttggaaagtagctggttggcctttagcttcgccgccattccatttcaaaaccggagtaacttctacaaccgcttttttgttgaaatacttttcaggaaatttaccattgatggtcgcaggaactttaccacctactgcctccagcacttgcggagtaacagtgaagtaatcagctgacaattcacccatttttttgctgcaagaagagaataatgcaacaaccattgccatgagtaaaggcaagtacaacttcttagtcattttaggtataaattaaatgtttgtaattgaaatatcgtctatttgccaacctccttctgctcacacagaaaaagtaacgcaaagatattaattcttaatataattatatagataagggggcgattttatcataatttaatgaaataactcctctttttctttcctatacttgatatttcgtgggtgatgctcgataatctcactacgaagcatattgcggtcgatgtgggtatagatttccgttgtcgcaatggattcatgtccgagcatacattgaatggctctcaaattggctccaccttccagtaaatgagtggcaaaggagtgccggaaggtgtgcggactgatgtttttggtaatacccgctttttgtgctaattcttttatcatatgaaagatcataatccgggaaagacctttgcctctccgctgactgacgaaaacgaaatcctcatgcccttttttcacttcaatctggttacggtctgtgatgtaaagctttatttcattaatagcccggggggagattggtacgagtcgttgtttgcttccttttccttctactttgataaagccttcatcaaaatagaggtcggatagtttaagggtgataagttctgatacccgaagtccgcagctgtatagtgtttctaaaatagctctgtttcgctgtccttcagctttgctgcggtcgacggcggagataatccggtcaatttcctccacagtcagtacttcgggaagtttgaaacctattttagggccttctaatagttcactgggatctgcttccagatagttttcgaggatgaggaaacggaaaaatgatttgattcctgataagatgcgggcttgtgaacggggatgaatgccgatgtcatgtaatccggccgcaaaacgttgaagatcggacaggcatacgtccaatacgtaaatcccttccaatgtcagaaagctcatcagtttgtccagatccgtcagataggcatccagagtattaagagataaggacttttcgagtttgagatactgctgatacttcctgattatcagctcttgttgttccttcttatgctttttttcgttgatttccatttcttttttctacctttgcacattctttcagatacaaaggtataaaaaaacaggattgcgcgatgaagatacaaattattaatggcccgaatattaatctgttgggtaagcgtgaaccttccatttacggaagcgttacatttgaagattacttggctgatcttcgcaaaagatacgttgacgtggagatcgactattttcaatcgaacatcgagggagaaatgatagactgcatacagcaggtgggatttgatgtggatggtataatcttgaatgcaggtgcgtatacacatacttccatagctttgcaggatgctattcgttctgtgacatctccggtgattgaggtgcatatttccaatgtgcatagtcgcgagtctttccggcacgtatcgatgattgcttgtgcttgtaaaggagtgatttgtggctttgggctaaattcgtaccgtttggctttggaggctttattggatagataataaataaggtaataatatataataggtagaaagactatgttattgaaacagactaagattgtggcttccatctcggatagacgttgtgatgtggattttataaaacagttgtttgaagctgggatgaatgtagtgcgtatgaatacagcgcatgctagccgtgaaggttttgaagctttgattgcaaatgtacgtgctgtgtccaaccgtattgcgattttgatggatacaaaaggtccggaagttcgtacgacggctaatgcagagccgattccatataaaataggagagaaagtaaagattgtaggtaatccggatttggaaacaactcgtgaatgtattgctgtttcatatccgaactttgtgtctgacctgaatatcggtggtacgattctgattgatgatggcgatctggaactggaagttattgataagacggatggttatttgctgtgtgaagttaagaacgatgctactttgggaagccgtaaaagcgtaaatgtcccgggtgttcgcatcaatcttccttcattaacggaaaaagaccgtaacaatattctttatgctatcgaaaaggatattgattttatcgctcactctttcgtgcgcaaccgtcaggatgtacttgacatacgtgaaattctggatgcacataatagtgatattaagattattgctaagattgagaatcaggaaggggtggataatatcgatgaaattctggaagtggcagatggcgtaatggttgcccgtggtgacttgggtatcgaagtgcctcaagaacgtattccgggaatccagcgtgtattgattcgcaagtgtattctggcaaagaagccggtaatcgttgctactcaaatgctccatacaatgataaataatcctcgtccgactcgtgcggaagtgactgatattgccaatgcaatctactatcgtacagatgctttgatgttgagcggagaaaccgcttatggtaagtatccggtagaagcggtgaaaacaatgactaaagttgcggctcaggcagaaaaagataaactggaagaaaatgatatccgtattccgttagatgagaatagtaatgatgttacggcgttccttgctaaacaagcagtaaaagctacttctaagctaaaaatacgtgctattatcactgatagttatagcggacgcactgctcgtaacctggctgctttccgtggaaagtatccagtgctggctatctgctataaagaaaagacaatgcgtcatttggctttgtcttatggtgtggaagctatctatatgccggaattggctaacggacagcaatattactttgcggcattgcgccgtctgttgaaagaaggccgtttgcagccttccgatatggtaggatatttgagtagtggtaaggcaggaacaaagacctcattcctcgaaattaatgtagtggaagatgctttgaagcatgcagaggagactgtattacctaacaacaaccgttatctttaatttttaaagaggtaagttttatgcaggaaaccgaatcaatagacgaatatattttgcagcatattgatcccgagagcgattacttgaaatcgctctatcgggatacgcatgtaaagctccttcgtcctcgtatggcttccgggcatttgcagggacggatgctgaagatgtttgtagaaatgattcagcctcgtcagatattggaaatcggaacgtatagcggctattctgccctttgtttggcggaaggtctgccggaaggtggactgttgcatacgtttgagatcaatgatgaacaagaggactttacccgtccatggttggagaaatcaccgtttgccgataaaattcgtttttatataggtgatgctttagaacttgttccgcgtttaggtgttacttttgatatggcttttattgatggcgataaacgtaagtatattgaatactacgagatgacattggcgtatctttccgaaggcggatatatcattgctgataatactttgtgggacggacatgtgcttgaacagcctcgtaatacggacgctcaaacaattggtattaaagcctttaatgatttggtagcacaagatgtgcgagtggaaaaagtaatacttcctttgcgtgacggattaacgatcataaggaagaaaatagtaagtagtaaatcgtaaaacagtaaataacttatggaaacaaccagacagaataagatatctcgcctgttgcagaaagagctaagtgagatattcctgcttcaaacaaagtccatgccgggtacattggtctctgttagcgcagttcgcattagtcctgatatgagtattgcccgtgtctacctcagtgttttcccttcagagaaagcagaagagatggtgaagaatatcaataacaatatgaaatccattcgttatgagcttgggactcgtgtacgtcaccagctacgtatcattcctgaactgaaattcttcgtggatgattcattggattatattgagaaaatagattcattgctgaagtgaaataactcattgcagaggtgaacttccctttttatatagccaggcgttatcttttttcaaagaaaaagcataatgctattaatatcatatccggcatttccgtatgtggggtggctcttgctacgcttgctttggtttgcactctttctgtttttaatggttttcaggatatggtggccagcttttttacggcttttgatccgcagttgaaaattacggtccgtgaaggaaaggtttttgatgcacaagatgaacggattcgtgccgtttgtgcgcttcctgaagtggaggtgtttacagagacgctcgaagagaatgcaatggtgcaatacaaggaccgtcaggctatggttgtactaaaaggggtggaagataattttgaagagttgacggccatagacagcatactttatggcgcgggagaattcgttcttcatgattcgatcgtgaattatggcgtcatgggagtggaattggttgcgaccttgggaactggtttggagtttgtcgatcctcttcaggtatatcttcccaagcgaaatgtcaaagtgaacatggcaaatcccggcgcttcttttaaccgtgattatctgtattctccaggtgtcgtatttgtggtgaatcagcaagaatatgatggaaaatatattctgacttctctcgattttcttcgtcagcttctggattatacaacagaagtctctgcgatggaattgaaattgaaacctaatgtaaatacttcatcggtacaatctaaaatagaaaacatactaggtgatgattttgttgttcagaatcgttatcagcaacaggcagatgttttccgtattatggagatagagaaactaatctcttatttgttcctcacttttattttaatgatagcctgttttaatgtgataggctctctttctatgttgatcttggataagaaggatgatgtagtaactttgcggagtcttggagctagtgataaactcatctcccgaatattcctctttgaaggacgtctcatttctctttttggcgctatctccggtattgccctgggcttaatcctatgttttatccaacagaaatttggtataatttcattgggaggcggtggtggtacttttgttgtagacgcctatcctgtcagcgttcatgcttgggatgtggtacttatttttatcaccgttttggcagtcggattcctttctgtatggtatcctgtacgttatttaagtaagagacttttatagctaaatggtaatgtttttattatagccatttttctataattgataacttttaattcctttttatggtgttttattttcgtaattgatacgatactgctatatttggctcaattttgttaattggaaataatctataaatacttctgtgaaacttgagaataatgaaatatgtagaatagtagacggcgatgaaattgctttcaatcgttttatggagcattattcttcgcgtttatatcactatacatttgcgctacttggccagaaggagtcagctgaagagattgtgagtgatgttttttttgaagtttggaaaaatagaaaaagtctggctgaaattggtaatatgaatgcttggatccagacaatcacctatcgaaaagcgatttcttttttgcggaaggaaactggaaagtatgaattgtcatttgatgatatcgaagattttatttttgagccggttcaatctccagccgaggagatgattagtaaggaagaaatggctaaaattaatgacgccattcaacaacttcctcccaagtgtaaacatgtctttttcttagcaaaaatagatggacttccttataaagatatcgcagatatgttgaacatatcagtgaagactatcaataaccatattgcttttgcgttagatgaaattgctaaaagattgaatctgaaatctcgcaagagctaagtttttactctcctgcttattaatgccttattttttcacatagctaatcctacttttatttgttttctaagaaaaatgaaaaaaaatcatttttgactgggagattttttttttagttgcgtctttatctatagaacaacattaaaaaaggattatgagcttgaaagaataccatcgtctcgcagatttatttagtaaattgaattctcaagaaaatattgaggatgattttacttctatgcctgatgcagagaaattgaaattcttttggcaaaattgtgcgcaggaaaagattgatccatcttctatcatagagaagactcaacgaaagatgcgaaaagatgctatgaagcgcagaaagaaatatttcttagttgcttcagcttctattgctgcttcctttttgatttgcatttcaactatttattttttgaatcagaatggaagtggtaatttagacttccaggctattgctgaagaaatggatagccaatctgttgaggaagtgactcttattacttccaaggaacagcttaatttggatgaagatgctttcattaagtattcgaaagaggggaaagttgctgtcaattcacaagtgataaaagagaatgaagagaaaaccaaagaggaacaagaatataatcagctacttgttcctgcggggaaaagggctagagtagaattgtctgatgggactcggctggtcgttaactctcagtcaaaagtgatttatcctcgttgttttaaaggagacattcgtaaaatctatgcccaaggagaagtttttctggaagttgcgcatgataagaaacatccttttatagtggagtctgatgattttaaactgcaagtgttaggaacgaagttcaatatctcgaattataaagggggggcaactaatattgtattggtggaaggtgcggtagaagttactgataagaatgaaaagaaagcacgcttgaatcctaatgatctgttgaatatagcaaatggtacaattgcttatcagaagcaagttgatgtagcagagtatattagttgggtagaggggatcatgctattgaatggtaatgatttgtcgcagatcattcaaagactaagcatctattatggtatatctattcaatgtgatccaattattggtaaagaaaaagtgtatgggaaattagatttgaaagatgatatagacgaggtgattgaatgtattcagcaaaccctgccattcacaatcgaaaaaagtgatactagtatatatttaaataaataatttttttaattaatcttttaatatgtttgcctatgaagaacagactgctattatgacaaaaaaaatcggataaatattgccgtatttacccgatagtaattccctagttaaatcaataaatccaaaattgttaacctaaaaagaaatttttatggtaaagaaaactatttttctacacttaaagaaaagacttaagcttttttgcattataaacgtcttttttatgattccattctcttcattcggtactaattctattagttggaattccgaagaagatttattctcagtacagtatgagaatgttacagttaaagatattttagattatatcgaaaaacatagtaagtatatttttatttactctgctaatgttcagaaaaatctgaataacaaagtctccatttcagtttccaataagaaaatagatgctgtattaaaagagttgttctcagagacaggactgaattataagatgtcggggagacaaattactatttcggtgccagaagctcctaaagtacaacaaactgcacaacaaaagggtattaaggtaacaggtaacgtttcagatgaaaaaggtgagcctttgattggtgtaacaatcattttgaaaaatgattctacagtacatgcgttgacagacatgaatggtaattatagtattattgttcctgaaagaaaatctgtactttcttttcgttatattggttttgttcctaaagaagaggttgttaataaccggaaggttgttaatgtacaaatggtagaagatgttggtcaattagatgaggttgtagtagttgcctatggcgcacaaaagaaagagtctgttgttggttctatcacaacgattgaacctgctaagttaaaggtttctactactcgttcaataagtaataatctggctggtacggttgccggtgtattagctgtgcaacgttctggtgaaccgggatatgataactcttctttctggattcgtggtattagtacgttccaggatgccggacaaaacccattggttttgattgatggtatagaacgcgatttgaataatattgatcctgaagagatagaatctttttctgtgttgaaagatgctgctgcaagtgctgtttatggagtgcggggagctaatggtgttattttaattaatacgaaacgcggacaagttggtaaacctcgtgtgactgtaaaggctgaatttgcagctacacagccggttaaacttcctgagtatttgggtgcagcggattatatgcaggttttggatgatatcttgatggatacaggacaacaacctaaatatacagatcgtattgcaaaaactcgtgcagggtatgatcctgatttatatccggacgtgaattggatggatgcaattgcaaatgattatgcttcgaatcagcgtgtaacagtagatatttccggtggtacagagacattacgttattcttttgttgctgctgcgtataatgaacgtggtattttgaaacgtgataaaagctatgattgggatcctactattaaattacaacgttataacgtgcgttctaatgtggatttgaaattaagtcctactacgcaattacgttttaatattggtggatatttgcaagatagaaattctacaacgaaagatatatctcaaattttccagaaagcgttcgttgctgttcctcatgctttccctgcacaatattccagtgggcagataccgacaacagaggagccaaacgtttggtcatgggctactcaaagtggatataaaagaaaaagcgacagtaagattgaaacactgttttctgtagaacaagatttgaaattcctgcttccgggattgaaagtaaaaggaacattctcatttgacaggttttcttcgggtactgtttctcgtggaaagacaccggattattatgtgcctgctacaggacgtgatgatgaaggtaatttgattatagcatcaaaatccaatggtactaatttcctggattactcaaaaagcggtgattatggaaataagagcgtatatatggaagctactttgtcttatgaccgtacattcgccgagaaacattccgttgctgcaatgttattgtttaatcgtcgtaattatgatgatggaagcaagttgccttaccgtaatcagggattggcaggacgtgcatcttatacctattcgggtaagtatgtaggtgaatttaattttggctataatggttctgaaaattttgccaaaggcaagcgttatggctttttcccttcaggagccattggttggattgtatcggaagaggcatttatgcaaccattgcgtaaagtcatatctaaattgaaattgcgtgcatcctatggtcaggtaggtaatgctaatttaggtggacgccgttttgcatacctctctacaattaccgatgactatgagacattaaacatgtataaatggggattggatagcagttatggcttaactggtatggcagaaggcgagtttgcagtacaagatttgacatgggagattgttaataagatgaatttgggggttgagctaggtttcctgaatggtatgattgatttgcaattagactatttcgatgaacgccgtaaagatatatttatgccacgtgagtctgttccaatgacagctggatttatgaagcagccttggaagaattttggaaaagtgactaatcagggtgtagaagtttctttaaatgttaataaacagtttggcaaggatttatttgtcagcttaatgggaacatttacctatgctcataatgaaataacagaaaaggatgaacctagtgcagtagttggtactaaccgtgctgaaacagggcatccggtagggcaattaactggctatatagcagaaggtttgtttacggcagacgactttgaagacgtaagtacaggtaaactgaaagaaggaattccgactcaaagttttgtaggtaaattacgtccgggggatatcagatacagagatgtcaatggtgatggtaaagtggacgtatttgataaatctccaatcggaggaacaaaagatccggagatagtatatggctttggactgaatatgaaatataagaatttagattttggagctctcttccaaggcataggtcgtagttggaatatattaggatcaagtattattccgggtgccaatagaggagtgacaggcaatatgtttactaatgcaaatgatcgttggactgtagacaacccaagtcagaacgtattttatccgcgtttggatgatggtataaatagtaataataaccaatcctctacgtggtggctgcggaatatgagttttttacgtttaaaaaacattgaacttggttattctttaccaaagaatttgtggagaaatactacagttatatcaggcattcgtcttttcgtgagaggaacaaatcttttaacattctcaaaatttgatttgtgggatccggaagtcgagaatactacaggggctgcgtacccaattatgaaatcgttatctgcaggttttgaaattaaattctaataatagggcatatgaaaaatagcatattaaaatttatagtattaagtattattacgacatttgctttttcttcttgttctgattatctggataagcaaccggatgaccagttggacttagaatcagtatttgagaataaaaagaatatggaacgttggctggcatatgtttatcgcggcctgcctgaatattatacttatgatggtccggatgccatagctgatgaactgattccttcggttggttgggaagcgcaaggatttaaagccattcaatatcaaaaaggtaactggacagcagacaatcccggagtaattacttattggaatacttatcctaaatatatccgttccgcttatttgtttatcaaacatgctcacccgctggaggctgtaccggctgaagaagtggactttatgaaagctgaatgtcgtttctttatagcttattataattctatgatggctatagcttatggttcagttcccattattcgcgaggctagtgaaagtacttcggctgatgatttgatgttgaaacaagagccgttttataatgtaattgattgggcggatcaagaaatgttggaagcctcaaaacaattacctgccactcaaactgaagataagaaatatggtcgtgtaacttctgtcgggtgcttggcaatgcgtgcgcgtatcttattatttgctgcaagtgacttggtgaatggtaatcctgcattggcgaatataaaaaacattgatggaacccctatctttaattctacacatgatccggaacgatggaaaagggcagtggatgcttgtaaactggttatagatgaggcggaagcatctggctatcatttgcattatgaatatttggataacggtgatattgatccttttctttcttatcaaaatgcagtgatgaagagatggaatgaagccaacagagaattactgtttgttcgtacaatggattccggtggatggtatgataaaaactgtatcccacgtggtttgggtattaatggcgtgggagcgatcggaataactcaatctttggttgatgcttttttcatgagaaacggtcaaagacctattataggctataattcggatggctctcctaaagttaatccagatgctaattattcagagacaggctttagtacgcaaaaagagacttattctacaaagtggcagtatgggtcttcagaaggagatcgtaataaagatgaaaatgtagttgtagacgccaatacatataaaatgtattgtgatcgcgagcctcgtttttatatttcagtactgcataacgaacaatggcatattggtggtaagagaaatactgacttttatatggatggtaaagacggtggtccctctcacgacgctccatggagcggctatctggtacgtaagagagtagacccatctgcaaatcccaaagaaggcagtggagattataaaaaccgtcatggtgcattatgtcgtttggcagagatctatttaagttatgctgaggcgttaaatgaatatagcattgagaagggcacttatactgctaatcaaaaagagattctgaaatatgtcaatttgattcgtgagcgtgcgggtattcccgaatatagtgtttcagctgaagaaggcaagataacagccccatcagatcctgtagaaatgcgcgagttaattcgtcaagaaaggcgtgtggaattgaattgtgaatctggacttcgttttaatgatctgcgtcgctggaaattagccgagaaagtattggatggtgatttttatggcatgaatgcttatattaaagtatccgatgcggactatagaaataaatattatactcgtacagtatatcagacacgtaaatttataagctattggtggcctattccacaggacgatattgataagaattggaatttggtacaaactcctgactggaccgtcggaaaccaataaatagttataatattaatatattgaatatagatatgaaaaacggatatatatttaagaagaaccttttacggttcttcttcctgacacttgcttcgtgtttcatggtagcatgtaatgatgatgacgatactactgatttgctcgataatcgtacaagtttagtcctgactccttctgattatgaaatagaactcaaggaagataccccggatgaggttgcattgacgttaaactggacggaagctgatccaataggctctgactattatatctcctatctttataaaatggatctggaaaataacagttttggaacaaacacaatgataagagagtatattgatgatgatttttctaaaagttatactcataaagaattgcaaagtttattggtgtcaaagtggaagcagcatcctggtgatttagtaaagttacaagcccgtattatcggttctatagaaggcccaaagtttgtaaaaccggaagtttctacagttactataaaagtaaagatgtattctgaaaagacctttgttgcagaccatctttatatgtcaggcacagctgttaatggtgaagatattgaaatcttgccaatggaaagtcagccgaagcgttatgtttccatttgtgacttgaaggcaggtaaccttcacttcccgattgtttggaaagatgaaaataagattaatgccatttcaccagttactgcagaacaacagattactgatggagcaatggaagctaaaattaagggaacagataatgctggatattgggtgattcctgaagatgggcagtatcgtgtagtggtagattttgaaacacgtaccgttactataggtttggctagtaattttatagaagctgataaaatctatattgccggaacttgtgttagcgcagatgtagagatgactcgcacgatagaagatgaaaatcaatatgcgttccatgcagaactgcaacctggtactatttatttcccgatcttgtttaatggacagaaagatatggctattgctcccgaagaatcgggcgattttacagatggtacagcaatgaatatctcgacaatgagcccggaagcagctgcacttgcttatcattggaatattaagactgcaggtgtctatcgtgttgtgattaatataaatactaaaaaggttacgatttactcccccgaaacagatcctaaaccaatggttgtttcgtggacatggaataataatacggtgactaccactattgaaagagtctttatttggggaccatacgatggatgggctaaagatggcactggtgatacaggattcactatggctcattctatgacacctagtttggcaaatccttatttgtttatatacaaaggagcggagttacccagaaagaattccattaaagacaaagatggaaatgcacatccgggtggattgaactttaaagtcggaccgcaaagtgccggttgctatacctttggttcaacagcagatgccatcagaggatcttatgacggttgccttgatattgcagagagtgactacaatcagaaacagactgtagtcggtggccaagctaacaaccgctatgctttctttagtgtacctgtaggagttaattacatagaattagatattaaagaactgacagtattctttgataagagataatcaagcaggataaaattaagagtgctatatcaatctcgtgatttttatatgaataaagagaacaatgatatagcactctttaaaaaaacaattagtagtatggttataagaaagattagttattatagagtaattgtgtctctttgtctgtttatgttccttttatctcctgttttcggagacgagaattcagccgtttcatttgataaggaactatcagagaataacatagttacgattcagcctgattctttgcgtattcttcataacccgcttacaggatgggtgctctatgcaagtatgggagtggatgctgcagatttttgggcacagtatgaccatatgtatattcctgaactgggacacaatgttagtgtgacagattatgctcatacgctttatattcgcgctagttggacagattttaatccacaggaagatgtatatggttggaagattgattctaatttgagagcatatattgaaggagcttatcagcggaatatgcgtttggcatttcgtgttgtagttgacagtcgtgataagagaacagaatttactcctcaatttgtaaaagatgccggtgcaaaaggatttatgaataaaggtaaatggtcaccttattctgacgatcctgtttttcagaagtactatactaaatttgtgaaggccctggctaaagatttcaacgatccttcgaaagttgaatttatagatggattcggacttgggaaatggggagaatatcatacaatgatttattcaacaggtgatgatactccaaagaaagcagttttcaattgggtgacagatatatattctcaagcttttgataaagttccggtagtaattaactaccatagatggattggtgcgggaaaagattgggtagatgatgaacattttgctgctgacagtgaagaaatgctggaagaagcaatcaagaaaggatattcattacgtcatgatgcatttggtatgacaacctattatggtagttgggaacgtaggtttgcagaaaaatatcgtaatatatgccccattattatggaaggtggctggattgtcaaatcacataattattggcaggatcctagaggatatcgcaaggattcacacgaggacgtaagacgcggtgagtttgatgacagcaaagaggcacatgtcaatatgatggattttcgttttggtgatacaaagtcctggtttaaagatgcttttgatttagtacgccgattccttcgggaaggcgggtataggctctatcccagtgaaatctctttgccgttagaagtctctaaaaaaacaccgccgactattaaacattgctggaacaatctgggatgggggtactgtcctactaatattccgcaatggaatcaaaaatataaagtagctttcgctttgcttgattctgaaacgaatgaggtgcgatatacatttgtggatacggatacagatttatccaagtggataaaaggaagtcccgctgaatatgtatttgagccggatatgtccaaagttgaaacgggtacttatgtttgggctgtgggcttggttgaccggagtaataaagatctcgtagggctggatattgccgccaaaggggatatattggattcgggctggttaaaattgtcgaaagtaagcataaaaaaataagagctataggtatgaagattaattttcaaaatatgtgcagtttgagaaaaataagttgcgggcttattttttctatggctatatcattagtcgcttgcggcagtgataatgatgaagaaggaggtgataatggtgatgatggtttggtagaagatacttctattcctgggaacagcattgtcacggtaaagcagaatcgaaatatcattttgcataatcctctttccggatgggtattatatgcgggtattggtgatggtttatcttccacattctggcaggattatgataatttcccgtcatcagaaggcactgtaaaggtctctgattatgcaaataccttataccttcgtggtgcctgggctgattttaatcctgaagaaggaaaatacgcatggaattccgattgtgataccccttcggctaagcgactgaagatgttgatagagggagctaagcaaagaaatatgaaattggcctttacttttgtggtggatagccgtgataagcactataattttactccgaattttgtaaaagaggctggcgcgaaaggatatgaaacacaaacaggttcagtaaaagtatggtctccctatccggatgatcctattttccagaaatattatgagaaatttatcagggctttggctaaggattttaatgatcccgacaaagtacagtttgtaagtggttcaggatttggaaaatggggagagtatcatagtgtatggtactatcaggtgcgtgagttgggaaaaccggagctgccgactcgtgaggctgttttcgattgggtgacagatttatattctcaagtatttgataaagttcctgtgtttgtaaattatcatcgttggataggtacaagtaaggaatgggacggcaataattatgataaagatactgaaagattaataggaaaagcagtagctaaaggatattcattacgtcacgatgcgtttggtatgaaaacttactattctacttgggaacgcaattttatagccaagtggaagtatctcgttcctgtagtaatggaaggtggctgggtgaaaaattctcatggaaactcgattctgggagatggatatgccaattatgcagaagtacgtcaaggtgagtttgatgaggctaaaacagcttgcgtcaatatgatggatttacgctataattcagactttcataatggagaagcttattcatggtttaatgaagctttccaattagttaaacaattctgtacagaaggaagctaccgtttatttccggacagaatttctttgcctacaactatctctaatggtaaacagattgaaatagcgcaccgttggaataattttggttggggatattgtccgacaaatattccccagtggaagaataaatataaagtagcttttgctttattggacaccaagaatgataaaccgaagtatgtatttgttgatggagaaccggaagcttgtgattgggtgaaaggtgcggctaaatcatatacgtttacaacccgggttgaaggcgtggaggcaggtaaatacatgtgggctgttggtattgttgatacgacaaagcagaatgagattggaattcaccttgctgtgaagaacaatgtgacatctgccggatggttgaaattatttgaagtgacagctcggtaagtcataatcaattgaaaaatagaaatgataactaaccgacgaaaaaacagatgagaaaaaaagttttgattttgggattgtgcctattgggagtcacacattctctttcgtcaaaagataaaaagagtattcctttgtataaggatgccaaagctccaattgaaaaacgtattgatgatttaatatcgcgtatgacattggaggaaaagattttgcagctaaaccaatatacattgggacgaaataacaatgtgaataatgttggcgaagaagtgaaaaaagtaccgtcagagattggttctttgatttactttgatataaatccagagttgcgtaatagtatgcagaaaaaagcgatggaagaatctcgtttgggcattcccatcatttttggctacgatgctattcatggatttcgcaccatatatcctatttcgttggggcaggcctgttcatggaatccgggattggtagaacaggcatgtgcggtatctgcacaagaagcccgcatgtctggggttgattggactttttctcccatgatcgacgtggcacgtgatcctcgatggggacgtgtagccgaaggatatggtgaagatccttatacaaatggagtgtttgccgctgcttcggtgcgtgggtatcagggagatgatatgtcagcagagaaccgtatggctgcttgtctgaaacactatgtaggttatggtgcttcggaggctgggcgagattatgtttataccgaaatttcagctcaaactctttgggatacttatctactgccctatgagatgggggtgaaagctggtgcggccactttgatgagttctttcaatgacatcagtggagtacctgggtcagctaatccttatatcatgaccgagatattaaagaaacgctggaaacatgacgggttcattgtgtctgactggggggctgtggaacagttaaagaatcagggattagccgctacaaagaaagatgctgctcggtatgcttttaatgcggggcttgaaatggatatgatgtctcatgcctacgatcgttatctgaaagagcttgtagaggaaggtaaggtaacaatggcacaagttgacgaatcagtccgtcgagtattgcgtgtaaaattccgtctgggtttgttcgaacgtccttatactccggttactaatgagaaggatcgttttttccgtccgcaaagtatggctgtggccgctcaactggcagcagaatcaatggtgctgttgaaaaatgacaatcagatattaccacttacaaacaaaaaaaagattgccgtagtaggtccaatggcaaaaaatggttgggacttattgggttcctggtgcggacatggaaaagatacggatgtggaaatgctttatgatgggttgactgccgagtttggaggagatgccgaattacgttatgcaatgggatgcaaaccgcagggcaatgaccgttcaggttttgctggcgcattggacgttgctcgttggtctgatgtagtcattgtttgtttgggtgagatgcttacctggagtggtgagaatgcttcccgttctacgattgctttgccacagattcaggaagaattggtgaaagaactaaaggaggctggtaaacctattatattggtgctttctaatggacgtcccttggaattaaatcgcatggaacctctttgtgatgctatattggagatatggcaaccgggaataaatggtgcacgttcaatggcaggaattttatccggacgtatcaacccttccggtaaactagccatgacgttcccttattccacaggacaaattcctatttattataatcgccgcaagagcggacgcggacatcagggattttataaagatataacaagcgatccgttatatccgttcgggcatggattaagttataccgaatttaagtatggcactgttaccccttctgctactaaggtgaagcgcggcgataaactgtcggcagaagtgaccgtcaccaacaccggtgcccgcgatggagcagagactgttcattggtttatttccgatccttattgctctatcacccgtccggtgaaagaactgaaacactttgagaaacaatttatcaaagccggagaaacgaagactttccgtttcgacatcgacctggaacgtgatttcggttttgtcaatgaggatggtaaacgcttccttgaagccggcgaatatcatattctggtacaaggacagaccgttaaaatagaactgatagactaaaaatgtaaagaacaaaagtgtgtgaagagctgatagctaagttggtttttacacatattatattaacacagaatcaccatgaaaaagaaaataggaggcataggtttatgtatgcttgcatggagcatattaacctgtgcacagacaatcactccccaagccgaacaacgtgcgaaggacattgtatcaaaaatgactttgcaagagaaaatagagtatatttccggatataccagtttttctctgcgtgccattccccgtttgggaatacctgaaattaagttggctgacgggccgcagggaattcgtaatcatgctcccaagagcactttatatccttccggaatactttccgcttctacttggaaccgggaattactttataagttagggcaaggcttgggacaggatgccaaggcaagaggagttaatattctgcttggcccgggcgtgaatatctatcgtgctccattgtgcggccgtaactttgaatacttcggtgaagacccttacttgacaggtgaaacggcgaaacagtatatcctgggagtacaatcggaaggagtcattgctacaatcaaacactttgctgccaacaaccaggaatggagccgccaccatgccagctctgacatagacgaacgtactttgcaggaaatctatttcccggctttccggaaagcagtacaggaagccaatgtcggcgccgtaatgaacagctacaatctgttgaacggtgtccatgccaccgaacataaatggttgaatattgatgtcttgcgcaatctttggggcttcaaaggtattctgatgtcggactggacttctgtatattccgccgtaggcgctgctaacgccggacttgacctcgaaatgccgaaaggacgttttatgaatttggagaatctgttgcctgctatcaaagccggcacagtgacagaagaaaccatcaacctgaaagtacaacacatcctgcaaactctgattgcttatggtatgctggataaggaacagaaagacagcaacatcgcagaggataatcctttctcccgccagacagctttagaactggcgcgcgagggtgtagtcctgttgaagaatgaaggaaacttgctcccactgaaaggaaagacagccgtaatggggcctaatgcaaatttgattcctaccggtggcggcagtggttttgtcactcctttttctaccgtctcagtggctcaaggcttgaaagaattgaagaaaaagaatctgttactattgacggatgatgtgatttatgaagatattgtccatgagttttatactgatgctaatcgtcagatgaaaggcttcaaagctgaatactttaaaaacaagaccctttcgggccagcctgaagtaatacgcacggaatcctctgttgattatgactggggatatggagcacctttggacggctttccgacagatggattctctgtccgttggacagcctgctacatgtcacaaactgacgggcagttgaaacttcatatcggtggtgatgacggttatcgtctgtttgtgaatgacaagcatattacaggagattggggaaatcattcatactctagccgtgaagttgaactgccggttgagggtggtaaggaataccgtttccggattgaattctttgataatatttcttcggccatcattcgttttaatgcttatagccttaatgaggcgaaacttcgtcaaggattggcaaaggtggataatgttgtgttctgcacaggtttcaatagtaataccgaaggcgaaggctttgaccgtccgtttgccttgcttcgctatcaggaattgtttatcaagaagattgcgtctatgcatcccaatgttgtggttgtactgaacgccggtggcggtgtggatttcaccaactggtatgatgctgcaaaagcgattcttatggcctggtatccggggcaggaaggcggtcaggcaattgctgaaatcctgaccggtaagatttctccaagcggaaagctaccgatttctatcgagcggaaatgggaagataatccagtgcacggcagttattacgagaacttaaaggcggagattaagcgtgtagactattccgaaggtgtctttgtcggttatcgtggatacgaccgttcgggaaaagaacctttctatccgtttggctacggtttgtcctatactactttcgcttatagtaatatggctgcggagaaaacgggtgagcatcaggttaccgttagctttgatatagagaatacaggtaagatggatgcttcggaggtggcacaagtgtatgtgcatgatgtacagtcttctgttccccgtccgttgaaagaactgaaaggatatgaaaaggtattcttgaagaaaggggagaagaagcgggtttctgttgtgctggatgaggatgcattctctttttacgatatgaatcaacaccgctttgtagtggaaaaaggagactttgagatcttagtcggtcctgcttccagtcaattgcctttaaaggctatggttgaactgtaatgaccgaatgataaacaaataaatatagaatgaaaaaaacacttttattgggagcgtctctgttatgttccgtttttataatggcaacagagattccttttcaaaaagcagaaataaagtctatcatgcgaaaggtggcggattggcagattgccaatccacaccccgctcctgaacatgacgacttgaactggccgcaaggtgctctttatgtcggcatggtggattgggcggaattggctgaaaaagaagacaatgatgatacatattataagtggcttacccgtataggccgacggaattgctggcagccggacaaacggttttatcatgctgatgacatcgctgtatcacagtcctttttggatttataccgcaagtacaaagacgaagcaatgattatccctacgctcgcccgtacggaatggattgtcaatcatccatccgaaggtagtttcaagctggtggagggagacttaaagaccttggaacgttggacttggtgtgatgctctctttatggctccccctgtatatgccaaactgtatatgctgaccggagagaaaaaatatatcaaatttatgaatcgtgagtataaagcgacttatgattacctgttcgataaagaagaaaacttgttctaccgtgactggcgttattttgataagtgcgaagccaatggcaagaaagtcttttggggacgtggcaacggttgggtgcttggtggtctggttgaaatattaaaggaactgcccaagaaagataagaaccgcaaattctatgaggaattatttgtaaaactggctacccgtgttgccggattacagcatccggacggtttctggcatgccagtcttttggatcctgcctcttatccatcaccggaaacaagttgcactactttcattgtctattccattgcttatggaataaacgaaggtttattggataaggaaatttatcttcctgtaatgataaaaggctggaatgcattagtctcggctgtggaaccgaatgggaaactgggttatgtgcagcaaatcggtgccgacccgaagaaagtgactcgtgacatgacggaggtttatggagttggtgcttttttgatggcaggcaatgaaatttacaaaatggcgagataatctgttccctctgtgaagatagtagacaataatcataaaaacgctgtactgtgatgaaaaaaatcttattgacatgcatagccgtagcctgtagccttgtggctgtagccgaagaactgctcatcgaagcagaaagcttcagccagcgaggcggctgggtgctcgaccagcagttcatggatcaaatgggttcgccctatctcatggcacatggcatgggcatccctgtggtggatgctacggcagaaatcaacattccccaggcgggcacttactacgtatatgcccgtacttacaactggacttcaccttggaccgatgccgagggccccggaaagttccgcctggctttaggcggcaaattgctgaaagctacattaggacataccggtaattcctggcaatggcaatttgccggaaagacagtattgaaagcagggactaccacccttgccctgaaagacctcaccggtttcgacggtcgttgcgatgccatttaccttacgaccgatgcgaatacgcagcccgctacctgggatgcggcagagacagccgcacttcgtacccgcctgcgacaacaacagccggtgcccgctcatcaatacgactttgtggtagtaggagggggaatagctggaatgtgtgctgccgcatctgctgcccgattaggttgtaaggtggcattagtgaacgaccgtcctgtattgggcggtaataactcgtcggagattcgtgtacacctcggcggtatcatcgaaatgggacctaatcagggattggggcgtatgatacgtgaattcggtcatgaacgttccggcaatgcccaaccgggcgactactatgaagaccagaagaaggaagactttatagaggccgaaaagaacattaccctttatgcttctcaacgtgcggtagccgtgaagatgcaaggagaccgcattgcgtcagtcactatccagcacatcgagacaggcaaacaaaccgaacttaccgctcctctctttagcgactgcacaggtgatgctaccataggctatttagccggtgccgattgggctatggggcgtgaaggtcgcgatgaatatggcgagagccttgctcccgagcaacccgactcattggtgatgggggcttctatacaatggtatagtaaggatatgaagaagaaaacctcattccctcattttgaatatggcgtgcgctttgacgctgaaaactgtgagcctgtaactatgggcgagtggaaatgggaaacgggtatgaaccgcaatcaagtcagcgaagctgaacgtgtacgcgactatggacttttggtgatatattccaactggagctatctgaagaatcactataaagaccataagaagtatgccaaccgttccctcgactgggtggcgtatgtttcaggcaaacgtgaatcacgccgtctcttgggcgactacgtactgtcacaggacgatatagacaagaatgtggcgcatgaggatgcttcgtttaccacgacctggagcatcgaccttcacttccccgacagcgtgaacagtgtccgctttcccggcaatgaattcaagtcggttacggtgcatcgttggattcatccttatgccgttccctatcgctgcctctattcgcgcaatgtggacaatctctttatggcaggtcgtaatatgagttgcacccatgtagctttgggtacggtacgtgtgatgcgtactaccggcatgatgggtgaagtagtaggtatggcagccggactctgccacaaacgtagtgtagagccgcgcgatatctatcatcatcacctgcccgaactgaagcaacttatgcaagcgggtctgggcaaacgcgatgtgcccgataaccaacgcttcaacgaacccaacaaattgttggaagttccgggagcttacatcaaaccgtagacaaactatgagcaaaaaaaatattattacgatatttctatcggcaatatgtaccttgccgctttggggaggacaacagtattacgcttttctgaaaggtgacacgctacgtataggcaataactatatggaacgcgccatgctgtggaataacggtgcacccgttaccatcagccttactgacaagcaacacggaaaaaacattccggtacagggcaaacaacccgatttctcgattgtgaaaggtatccctacggatgccacgctcaccgtgaacgagataccgacgaacggcatccacgccagttatctgcaggctaccgtggcttgcactatcggttcgctgaatatagagcgtcgctatcgcatttatgcagactgtcccgccattgcttgcgacacctatctgaaaggacaagtggaactttatcagaataaggaggataaccgctctaacgctgaccgcaaaaatatagagcacacggccgatatggctacgggggtgaaaactcccacgctcgacaggctgcaactatccggcaatcattggagtgcccgcacaatagagtttttcgactacaccgattggaacgacaatctggtgaccgggcgtacctggcttccttaccgtcgcaatacgtatcgtggtaatttgctttttgctcatgacgtagttacgcgtcaaggcttcttttttttgaaagaggctcctagcagcagtacccaattacattatccgggttctgacttcgtggcggactttagcgattttatggtagtggggctgggcattgcgtctcatgatgtaaagccggatagctggacccgcgtttatggatgcgttaccggcatctataccggcggcgagcaagaagcgcttactgccttgcgcctctatcagaaacaactgcgtcatcataccgccgcacaggatgagatgattatgctcaatacctggggcgaccgtagccaggatgccaaaatagatgaggctttctgtctggcagaactagaccgtgccgcacgcatgggcatcaccctctttcaactggatgatggctggcagagcggaaaaagccctaactcaaagaccgccggaggtagttttaaggatatttggaagaataccggttactggacgcccaaccccacgaaattccctcatggtctgaaacctattgtagagaaaggcaagaaattgggtattcgcatcggattatggttcaaccccagcatacagaatgattttgccgattggcaaaaagatgcgcaagccattatcggactttataagaagtacggcatctgctgtttcaagatagacggcctgcagatacctaccaagacagccgaacagaatctgcgccgactgtttgataccgtgttggagcaaaccaactatgaagtgattttcaacctcgatgccactgccggtcgtcgcggcgggtatcactatatgaacgagtacggcaacatcttcctggaaaaccgctataccgattggggcaactattacccttatcgcaccttgcgcaacctctggatgctgtctcgctatgtaccggcggagaagatgcagatagagtttcttaataaatggcgtaatgccgacaagtatgacgctgccgatccttttgcccccgcccgttacagtttcgattacctctttgctatcaccttggcggcacagccgttggcttggatggaggcttcgaacttgcccgaagaggcttatattacggcatctctgctcaagaaataccaacccttgcaactccggtttcatcaaggcgtcatactgcctattggtgaagaaccctcgggacgctcgtggaccggattccaatcgaccgtctccggcacgcaaggttatcttgttgtttaccgtgaagacaacgagcaagctagggggactattgacacctggcttcctgaaggcaagaaagtggattttatccctgtgatgggaagtggcaagaagtttgctgcaaaagtcggcgcacagggtagagtaagtttcgagctaaatgacaagaactctttcgcactctatcaatacgaagtaaaaccataaaaaggcggctatctgcattctacgctaataacgagtgatgtgttaacttctgattcgcagagtagtatggtaggtggagagaagcattaatacctctgctgttggatgttaatagttgagttgtcaggtattaatagctgagcggataggtattaatagttgagataatgggtattaatagtttgagacaatgagtattaatagctgataaatgggatattaatataacaacgacaaatgaaataaaatagggaactatggtaaaaagtgtacgttttcttcttctcctgatagcatttgtctccatgcagatagttgcatggggacagccgcaggaaagactggttcaagtgcaggtcactccagaccacaccaattggctgtataaaccgggagaaaaagtgaaattcaaagtagtggtattgaaatgcaatatcccacaggataatctggaagtacgttatgagatttcggaagacatgatgaaacctcatcagacaggcaaacagcctttgaagaatgaaaagcttgaaattaacgcagggactatgaaaaaagaagggttcctgcgttgccgtgcttttgtcacttgccaagggcgtgagtatgaaggcgtggctaccgtcggcttttctcctgaaaaattgcaaccgaccactccgttgcccgtcgactttctggaattttggaaaagtaccaaagaagccgctgaaaagtgggcactggaaccgataatgactttactgccagaaaggtgcacggataaggtgaacgtatatcatgtctcctttgcgaacaatgactatgcgtcccgtatgtacggcatcctttgtgttccgaaggcttccggggaatatccggcgattctgaaagtgccgggcgcaggcatccgtgcctataacggagaagccgaacgtgccggaaaaggttttattattctggaaatcggtatccacggcattccggtcaacctgacgggagatgtgtatcaccggctttataacggtgctttgaagaattaccactcgttcaatatggacaatcgggacaagtactattacaaacgggtttatacaggctgtgtgagagccattgatttcatttacacacttcccgaatttaacggtaatctggcgacttttggaggaagccagggcggtgcgctttccattgtaattgccggactggatgctcgtgtcaagggattggtttctttctatcctgctttgtgtgatatggcgggttatgcccacggtcgtgcaggcggttggccgcatctgtttaaggatgagaagaaccggacaccggaaaagattaaaaccattcagtattttgatgtagtcaactttgcccgtcaggttaaagtgccgggattttatatcttcggatataatgacagagtttgtccgcctaccaccacttactccacttataacgtgattaatgctccaaaagaactgtttgtagctgaaacgaccgctcactatgcctatgccgaacagtggagcgcagcctggaactgggtaatgaatttcctaaaaaataaatcgaaataggcacggattacacggattaacactgttgttttacctattctattctaaaagccgtgtaatccgtgcctgaacttattatatacactaattataacaacatacttaaatgaaaacaggtgagaaattaagtctatgtctattgttgctaatcgcttttgccggaagcgttgcggcacaggagctgataacgaatgtatatggtcgcaacatccattcgctgaatggtaaatggaatgccatcatcgacctgtacgaccagggacaacggatgaaaatctatgaaaaccggcaaccggaaggaaatattgatttctacgaatatgcgtttgaaggcgggttgcgtcttaatgttccgggagactggaactctcaatcacccgaattgaagtattacgaaggcactgtatggtatgcccgtcactttgatgccaaacgcttggcagacaaacgccagttcctttatttcggtgctgtcagctatcgtagcaaagtctacctgaacggaaaagagatagcagagcacgaaggcggttttactcctttccaagtggaagtgacagacctgttgaaagacggtgacaacttcttggcggtagaagtgaacaaccgccgtaccaaagacgccattcccgctatggcattcgactggtggaactatggcggcatcacaagagatgtattgctggtgaaaactccccggacatttataaaagattatttcatccaattggataaaaacactccagaccgcatcatcgcccgcgtgcgtctttctgataaaaaggctggtgagaaagtaacagttgccatccccgaactcaaaatcaacgcggagctcaccaccgacgcagaaggaaaggcggaaaccgtattgaatgcgaagaggctgcaacgctggtcgccggaagaaccgaaactctatggcgtgactgtatcttcaagtgccgaccgtgtggaagagcaaatcggcttccgcaatatcaccgtgaaaggaactgatatttacctgaacgggaagccgacatttatgtgctgtatctcttttcacgaagaaatcccgcaacgtatgggacgtgctttctcggaagccgatgcggccatgttgctgaatgaagcgaaagcgcttggcgtgaacatgattcgcctggctcattatccgcagaatgagtacacggtacgcctggcggaaaagatgggcttccttctctggcaggagattcccatttggcaaggcattgactttacagacaatgatacccgtaagaaagcgcagaggatgctttctgaaatgattaagcgtgatcagaaccgctgcgcggtaggttattggggtgtcgccaatgaaacacagccttccaaagaacggaatgaattccttacttccctgctcgaaacgggaaagcaactggacactacccgcctgtatgttgccgctttcgaccttgtgcacttcaatagcgaaaaacagcgttttgtaatggaagattcttttacttcccaactggacgtcgtagctatcaataaatatatgggctggtatcatccgtggcctgtggaaccgaaagacgctatatgggaagtagtgacggacaaaccgttgattatctcggaatttggcggcgaagcattgtacggtcagtccggtgatgagaacgtagtcagctcttggagtgaagaataccaggcacgcttgtacagagacaatatccgtatgttcgacaatatcccgaacctgcgtggcgtatctccctggattctgttcgacttccgttccccattccgtttccaccccaccaatcaggatggctggaaccgcaaagggctcatatccgaccaaggtatgcgtaagaaagcgtggtatctgatgagagattattacatgaaaaagagaaataaccgataagtttagttatatttgaatgtgatgaagcaatataagattgtagtgatttgtatgtgcatactgctccttcttgccggaggagtgtatgcgcagcaaaaaacggtcaggatacttgccatcggcaacagcttctcccaagatgccgtggagcaatatctgcatgaacttgccgaagccgaaggcatttcaaccataatcggcaatatgtttattggcggctgttccctggaacgtcatgtgaaaaatgcccgtgacaatgctcctgcctatgcctaccggaaaatcggtacagatggaaaaaaacgggaaaagggtaagatgtctttggaaacggtgcttgcagatgaagactgggattacgtcagcctgcaacaggcaagtcctttttcgggaatgtatgagacgtatgaagcttctcttcccgagctcatagaatatgtaaaagcacgccttccaaagaaaacaaagctgatgctgcaccaaacctgggcgtatgcatctacttccaggcatagtggatttaaaaactacaactgcaatcaactcaccatgtatcaggctattgccgatgcagtgaagaaagcggctaaggcgaataagataaagattgtcatcccttcgggcactgccatacaaaatgcgcgcacctctttcatcggcgaccacctgaatcgggacggctatcatctggatgtgaagattggacgttataccgctgcctgtacctggttcgaacgcatcttcaaacacaatgtagtcgggaatccttataccccggaagggctggatgaggcacgaaaagctgttgctcagaaagctgcccatgcagcagtaaagcatccgtataaggtaaccgatctgtctattactaactaacaatggacattgccgcccgtcttgcagcagaatccatggtattatagatgacttgattcaaatgtaaatgcagcacaccaaaggcgatttgattgctcgtggcaacccgatggtgtactgcatttatttttcgtatattgtatggtttactccattaagaactggcgtatagaacaatggcgtataccctcgtagctatttccgctgaatgtatcttctgttaccactattttgggatagttgtcctgtatctttagcaggtttccaaattctctttctgctgtcttgtcgctatctatttttaaagcgacctgtatatatagtttttctccattcttttctccgacaaagtcaatttccttatctccgtaatagccaaccttaatatcgtaacctttgtataaaaggtggttatacactagattttccaatattttggctttgtctgtaatgcgatatccgatgacaatgttccggattcccatattttcgaaataatatttctctcctatctcaaatacgcgtttcccaattaaatcataccgctctactcggtggataaggaaagcattgtttaaatattctgtatagctttgtatttggtttactgatatggcggtatgttgtgattttaaataatcactgatattctttgccgagaagagattgcctatgttttcggataaaaattgaatcagtttctcaaggaacaaagtattgcgtaacttgtatctactgacaacatcacgaaatacaatcgtggaatatacactcttcaaatattcattgactgtttcatcttcgagaggtagatttaataaatagggaagtccgccataacggctatataattcgtaactcgtttcactttcagttaatccgtggaattcaagaaactcagaataggagagactatatattttgaattcgatatatctgccacttaaataagtggcgagttctcctgaaagcatcttggcgttactacctgtaatgtatatatcattatcttcattgagtaggagcgaacggatgactttttcaaacccgggaatatcttgtatttcatcgataaagatataattcttaactttttctttgctatgagaaatgatgtacgagtgtaaatcttctgctgtttgtagagaactgaatgtaaaatcttcaagattgacatagataatattcgcatccggttcttctgctaaaatttcttcaataagttggtaaaggaggaaacttttgcctacacggcgttgccctgttaacaccttggctactgatttttgcataaaaggttttattcggtcaatataaccttttctttttttgaggattcgaggaaagttcatgggcctgaaagttttaattataccttaaactcttgcgaatatacggaaaagttttaattataccttaaactttcggagatttaatggaatgttttaatcaaaaccctcttattgaactttcatgctataatccgctttcagccgtttctgctttatctgtaaacgctttgctggaaggagatagcggctgaaaccggaaaatatcatcccttgcaggaaggtactgtaggcaagggggagtgctttcagcgcattcagcttttcaggcttactagtagagctatatattcagcgtgatgggtatatatactcaccatgctgaatatacatgtccaccaagcgggatctatagatccaccacgtgggcaaaagtgaggtgaaatgtgggcttatggctgcttgcgcgtgggctcgaacacgccagcacgtgggctgaacaaaacagagcctgtatttgggtaaaacagaggctctgttacaatgaaatgcaggctccgttttgttacaacagagcctctgttgaaagtaaatatggcaaaaggaactggagttaaacacttttgctttcaggagtgctttcagcaaaaatcaccgatgaaaaggggcttttttaaagaactgaaggctgaaggcggtttttattctaatagttagtaaggaatttgactgtaacaagaaagggaatcaagtttctttctccatcttttatttttcattgcaacaaaagcatgctttcttatagggaatcagtcctttttacagttgaattctgaaggcaggcatccgaactcttctttgaaatatttagcgaattgtttgggtgacagtcccacttgataagctatttgagaaatgctttcctgactctgttctaataattgctttcctctttttatgcgcaagacacggataaattcaagaggggacttgcctgttatcgtcattagttttttgtataagtgaccacgactcattccgacagtcatgcttaggtcttcgacagagaaatctgtattgtccatattctcttccactgcttgtatggctcgctcaataagcctttcatcaatagtgctgatggtaatctcggcaggagacacttcaacttttccgaatcgttgatggttgcggctactccattctaacagcttttggatacggagtagaagaatatccagattgaaaggcttggttatatagtcatcggcaccttcacgcaatccttccagcatatgttcctgggcggttcgtgcagttagtaaaataacagggatatgtgagtaacggaagtctccctttatcttattacatagctccagtccgttcattatcggcatacggacatcgcttatcacaaggctgatatcatgcagggccaatatctccattgctttttcaccttgttcggcctcataaacagtaaatcggtctttcaggcagtcaacaatgaattgtcggaaatcttcgttgtcctccacaataagtaatgaacgacctgttggcgtttttgcttgctccggttcttcctgtatgtctggtctttcagttggcgttgccgtgggatttatgttcttgcattcatgtcgtatggggaacataaattcaaagatagtaccttggggatgattatcgcgaatttgaatgtcgccattatggagagtaacatattctttgactatatgcatgcctatgccactgccgatataatcagtggatgagtgctcttcttgatagaaacggtcgaatattttagctttgttttcttcacgtatcccgattccggtatccgccacttggatgcaggcatattctctttcatcttttatgatacgatccagcactacgttcacgcttccgtgattcacgttgtatttgaatgcgttcgataatagattaagcattatgcgctgcattttattcttatcaaagtctgtttccagattatcggttttcaatgaaaggctgaaggcaatattctttttgtcgccgtacgaatagaaagaatcacatacttctttgatgaaatctgccaaatcaccgtgggaaggattgagttgggctttaccattatccagccgacgtaaatcaagcagttggttgataacgtccaggagtgccaatgcattgcgatgaatcaacttcaattccttttttatgtcttgtgccgtattagtagccaatatttgctcaagaggagtgatgataagtgacaaaggagtgcgcaggtcatggcttacattagtgaaaaagcgtaatttggcttcgtcaatttcatgctgctgcaccgtttccatatcacgtttttgttgaagcaataatcgacggtgtttccgtttcatgtggataaagataagtgatatggcactcaccaacagtaatgcatagatgctataagctatattagaaagccagaatggcggatacacattgatggaaagtgtagcacttgcatcgttttcataatcatgaaccttcattacccgtacttgaagttgataagttccgggagccagtttattgaaataaatccggtttccctccagctttgtccattcttcgtttttattgagtctgtattcgtattgtagcttgtgcagattgccatagtccatagccgagacttccacagcaaaactgttgtctgaatagttcaggttgaggttgttaagcaactggatgttctttgtgagaatgatacgtccgttgtgtgcgggcctgtttgcattgacacactcattatcaatatataagtcggtgaatattacttggcggtcgaagtaaaacaagtcattgccgcgtgggataatttttacgtatcctcctccgcctccggcaattacttcattcctgtgattgcagaagattgaaaaattattgaaagtaaggttaccgattccatcctcttcataataagggtggcaacggaagtcgggcatactggtagcatcggattccactacttccacgtgggtgatgccatggtctgtagtgagccacatattgtgagatgcatcttcgataatggcacgtatatatgaatgggaaacaccgtttgcggtattcaaattgattaacttattttgcttcgggctatacacattgacccctttccgtccgcctatccatagtagtccgcgtgaatcttgatagatgcaattggcgaacttatcttgtatcacttcttcaccgtcggcagtttgttccaatatcgtcatttcccgggtggaagtattcatgtggtacactccggaactggtagccacataaagagaatgaccatcaacatatgccaggtcggcaatgtaattggtcagtaaagttgaattactcattgtataatctttgagcattccggaaggttccaggcagtagagtccttgcgagtaagtggcaaaccataagttaccggcattatcctgtgtgatacgacgtatgtattgaggcagttccaccggattattttccgccgctttgagcggagtgaactggccgttctgataataaaacgctccaccgccgaaacttccccaccacactctgcctttgttgtcatggaaagaacaaacaatcaagtcggaaggaatttctttgttctttgatttataataagtataggtgtttttatccttgtcgtaactggctatgccttcaccgtcaaatcccagccatagtttgccctctccgtcttcgtagaaacaactgacatcctccagttggggacaataatggttttcgaatatcagattgttcaaacctgaataggctacgccctgtttgccggttcctatccatatcacgtcgcggttgtccttatagatataggtcacgtgattgtccggcagggaatataatttgtcgacatccttgaatagacgcgtcaccttgcccttttctttatcatacgggcatatgaatattcctctgccatcggttcctatccagatattccctttgccgtcgtcggttattgtggtaatcatggttcgttctctactgagttccgttcgggcggcaaagtcaatccagttgttttctgtcagagaataacatttgacatccgcgctgtgcggggcgtacacccaaagctgggaagaaaagtccagataaatgtgaggcacataagtggtatgtatttccgtatgaaacagtttggttatggatttatgcatccagtctatgttaattacatttccatcggtcatgagaatgtaacatcttttgttgcggcatgccatgtcggcaatgtttacgctgcccggaagtgactgtttgtacagcgtttcatcggagaagatgtagtaatacaatgtgttgtctgcaacacaccacaggttcttgtcgtcatctatgaataattgcctggggctttcaaagatacctatcttgtgcagaagaagctccgttctgttatccagttcgtccatttcacggtcataaaaacaatagttaaccggagtttttatccatatattgcctgctgcatcttctgctacccattctacgctattgttgtaagctccttgccggagggtggtataagtcttgaaatgatacccgtcatagcggttcaggccatcacgggtagcaaaccacatgaacccatatttatcccgttctatcgcctgaatataattgtcggacatgcctgtttttactcccagctggtgaaaactcatttcgtttgaagcgtatgatgccaggctattcagcaaggagataagaagaaacaaaggaattcgtaagtgtcttttcataattgtatcttttcacgttgctaagttaagaattccgttcataaatcccttatcccgaatgtatcattttaggggaagatatgtgtcttttgtatctttttctatcccgaatcgattattctccggtcgggatacaattcggatagtttgaaaatcaaatgagaaataggcggtacttttttattcgtacatttgccacagtcaaaaggaagtccttaaatcgacagaataaaaacctatcaaatatttatattatgaatctaaaatccagaaaaacagtatttatcacagggctctgcttggcatctctggttagtggtgttcctcttcccgctaatgcgtctgccgacacgacagcaatgatacaacagcaatccgttaaaataaaaggacgggtgacggatgcttcgggagaaccggtgattggtgcaaatgtagtacagaaaggtacgacaaacggaactatcactgatttgaacggtgattttacattaaccgtttcgcaaggggcggttttacaggtcagctttattggctataagcagcaggaagtatccttaaagaacggacaggcccaggtgactgttgttcttaaggatgatgcggaactgctggacgaggttgtcgtagtgggttatggtacaatgaagaaacgtgatttgagcggtgccgtttcgcagataaaaagtgacgacctgatgaaaggcaatcctactgatttgagtaaggggttggcgggcaagattgccggtgtgcaggtgaatcagagtgacggcgctccggggggcggcatcagtattcagattcgcggtacgaactctttctctaccaactcacaacctctttatattgtagacggcgtgccgtttgatacgggagataccccagccagtgacacaaataacagtcagaataaatcaaacccattggcatttatcaatccgcacgacattcagagtattgatgtcttgaaagatgcttccgcgactgccatatatggttcccgtggggcgaacggggttgttatcataaccaccaaacgaggtgagaagggaaatgaaaaggtggaattcagtgccaactttacattctcgaagatagcgaaacgtatggatgtgctcgacgcattcacttatgccaattatcaaaacgaacaagtgcttaatgattataaatatagtaataaaccttatggcaagctgccgtatcccggggcttgggaatatccggccttgccgggtggcggaaacgatacttctgctggcaaatacctgccggcaccggaagacttcctccgaccgggtgattatgtagatgaatatggtaacatttcctatgtgggggtggccgactggcaggatttgatttatcagaacggcttttcgcaggaatataatatcagtgtatcgggcggttcggacaagggttggcactcattctccggtaatttcctcaaacaggacggtatcatcaagaattccggttttacccgttattcattacgttccaatataggcaggtatataaccaaatggttggaaatgggcatgaataccagtttcacacatactgatacggatttctcgaagaccaactcttctgattgtggtgttatccgttctgcattggtgtttccctcgacgtatgatccgcagaagaataaggcggaaactggtgaattgagctggcttgcatctaatccgttggcttatataaccaacacaaaagataatttgcgcagcataaatgtgttcaattcaagctatatggaggttaaacttttgtcttttctgaagttcagacagaatttgggtatcagttatactaacaatgaccgtggcatgtactatggccgcgaaacgcaggaaggttcgtccactactaatatcaatggcaaggccgaacagtcaagcaactggtggttgggaatcaccgccgaatcactgctgacgttcgataagacgttcggtatccatagcgttaatgcggtggtaggttttacggcagagaaatccagttggggaagcaaagcaatgtcggccacgggatttcccaacgacatcactcaggatttcgatatgagtttgggagctaatccgggcaaattgaggtctgacaggggagatgcagctttagcttcattcctggcacgtgtcaattacactctcatggataaatatatccttactgcatcctgtcgtgctgacggttcgagtaagtttaccgataagaacaagtgggctagtttcctttctggagctgttgcatggcgtatgtcggaagagaagtttatcaaagatttggggatattcagtaacttgaagttgcgcctgagttatggtgaaacgggtaaccaaggtatcggaagttatcgtacgctgccaatgcttaatatggcaaactatccttttggcggggctatcaacagcggctttgccgaagtggactggagaggcccggtttccgatgacttgcgctgggagacgactgcccaatataatgtgggaattgatatgggattcttgaataaccgtattaacctgacggtggattattatcataagaaaacacgcgatttgcttcaggatgtgaaaatcccttcaagtaccggcttcggtagcatgatggtcaatagcggacacatcactaatgaagggcttgaactgaccggtaagttctatgtgttgcagaatacaccgctgaaatggaatatcgatgcgaatatctcgttcaaccgcaacaggattggcggactgaaagcagaccagtttgcgcagaaattatggagttcggctgatgaggtgttcatacagcgcaacggttgtcctatcggggctatatatggttatgtagaagatggattctatgataatctggcagaggtgatggcttcgcccagtgcagatatccgcgcaaaaggcgccggtatgattggtgaaataaaatacaggaactttgatgataatcccgatattacttcggccgaccgggtgattatcggagatacgaatcctgattttgtttatggacttaccagcaacttcgagtggaagggcgttacattgagctttttcctgcaaggaagtcagggaaacgacattttcaatggcaacctgatggatatgaagatggggaatgtgggtaatatcacccatgaagcctataatacccgctggacagaagccaatgccgcccaggcaaagtggccgaaagccgtttcgggctacgaacgtaatatgcttatctctaaccgttatgtagaagacggctcttacttgaagctgaaaagcttgaatatcgggtatgtctggaaacctaatttcaaaggtatcagcaatgtcaatgtgtatgccagcgcaaccaatctcttcaccattaccggctatagctggttcgaccccgaagtgaatgctttcggttcggatgcctcccggcgtggtgttgatgtgtattcctatcccagcagccgcacattctcattgggcataaaagtagatttttaagatgataaacaattaaatgtaactccatgaaactgaaaaaaatatatatcctgttatctctttctttagcaggcatgacaactttctccgcttgccaggatttcttgagcgaaaagccatattcttttgtgggcccggaagaggtgggcaacgatgatgctgcagtcagccaatgggtgaccggcgtgtacagtaaatgggcggacgatatgttccgttgggggaatttcccccgcgtgcttgatatggactgtgactatgcttccggccctgactgggcattcagcaatgcaggtgccggcaattatcagggagatgatgtgaccaataccatttggaagggttgctataacttgattaatcgcgctaatgtggctattaaatatatcaatgcaatcacgggtgccgatgaacgggtaaagacgaacggtctgggtgaggtgtatttccaaaaggcttttgcctattttatgctggtaaaggcgtatggtgagatcccgttgtttgacagggctgtcacggacgggacgggatacaacaatcctcgccgtccgatagccgatgtctatgctgaaatagttcgtcttttggaagaggaagccattccccgtctttataagaatacggatgcggagtatcagacaggacatgtatgtgcaggaacagctgtcggactgctcgctaaagtatatgcaaccatggcttccggtgcacttcctgcaggtgagaaaatgacagtgatgaccggttcgtcttattcatacaatggtgacgataaagtcttggatatgcctgtaaggcgggagtttgtaaagactcaggtgaaaggttacgagagtttcgattggagggattgctatgaaaaagctgccaaatgggcgggatatctgctctatcctactccggacaacaactacggcagccatgacctgcttccttatgaccaactgtggaagcgttccggactggggcaaagtaccgaacacctgtttgccttgcaaggtgccaacggtgatgaactttatggaaacagtatctttgaatggtacaatgggattgacaatggacgcggtgtagtggtcagcggtctgtatatcggcaaccgttatcactggtatactctgttcacctctcaggattaccgtgtcacacaaggagtgaaacatcgttttatagtaagctatcaggacgaagagggaaaaccgaagagcggctttttctatccgaatacgccggagtacgtgctgaaggccacaggctatgatgctaacggaaattatgtggcagaaccggaagctccctacaacgacggacgtaactattactttaacgtatcgaacgagtgtctggcattcaccaacaaatatgcagacgttacagacgccacacagaaaaaatcggatgcctactggcctttccttcgtctggctgacatcgtgctgatttacgcagaagcgaaatgtgaattggataatggagtatcttcggaggctatcagtgcattgaatagggtacgtatccgttcgaatgccactcttgcatcaagttccggtgatggagccattgcttccaaacaagccctgcgttccgccatttttgaagaacgtgccaaagaacttgcgctggaaggagacaggcgatgggatttgattcgttggggaatctatgtggaagtgatgaactctatcggcggaatcaacaaggacggttctcaaacccactacgatgaagccggtgtgaacaaacatcgtgaacagcgtcatttgctctttccattgccttctgatgaggtttctactaatgaagcgattgacagcaataatccgggttggagttaaagtgccttccctattctagaataaagtcagaaatttaaaatcaatatttcatgaaaagattatctttcaaatccataactcttatgtgctgtatggcgttgagctttggtgcttgtcaggacatagtgacctataatgataattatgatgacgaaatggcgtcaagcggtgcccccgttattgacgctgtgtatgactccaaagacagggataaattgttgccaatcactgacggaaatctggagcagatgattgtactcgacggttccaatttaagccgtgtgaggaaagtgatgttcaatgatgttgaacttcctgtcggtgaggtatatgcgactgccagcagtgcctatcttcccattccccgtcagattccgttggaagtgaataataagctctattatgaaacggagttgggaagtaccacttatgatttcacggtgtctgtacccttggttcaggtggacggtctatataatgagtttgctcttcccggcacatctgtacagctgaaaggtaaatacttcgacctctatgggttcggaggcgcgaattccacttctactgtcaaaatgaatggtgtcgagcttgaggtagattccatctcggacaaatatatgtcagttgtcattcctgaagatgctcaggataactctgtcatcgaagtgagttatatgggagcgggttctgttgcacataccgaaaaaatcccttatcgtatgacggatgcgattatctggaacctttctcatcctgatgattacggactctgggcaggcaaagaacttatcatcaatgaagcaggcgacaatgagcccgaaattctctatggaccttattttagggtaaccggcagttatggtgcctggaattggacgaatcttgtttgcggaggattcaactgtccggctgatgtggcggcagctcctgccgattacaattttaagtttgaggtttactctcctacgggacatccgttctacgattcggctggatatggctatctgattcagcttaataatggcaattatccgtggaatccttctgcgaatggcagtttcaatacttacgggaagtggtgtactgtttcgattgatttgcagaccgtgtcgggtaatgctttctcggaaggatggacagggttgtcattcattctccaacctaattcggattggaacgtagaccacagtttcgccaatatccgtattgagaagaaaatccggtaaatgattatagaaaataggtatgaagaatatatataactttttgatttatttcatcttttgcggcataggagcaggatgctcttcctcgtccggggaagactttccggctccggagtcggaaccggtggacaattcattgataaagaaagaactttgcaccgaaggtgcatccgttgaggctaagaaagtgtatacatatctgagaaactgctgggggagaaaaactttgagcagtacaatggcgaacgtgacatggaacgtcaatgaagcaatatgggtaaaccgtcagaccgggaagtatcctgccattgcctgctttgattacatgaaccttcccgcttcaccggccgactggattgattataataagatatcggttgttgaagactggtggaatgccggaggattggttgctgcttgctggcattggaatgtgccggtcacggaaaatagcagtgagtataaatgtatgattagtgaaacggattttgacatcaccaaggcattgcaggagggaacccgggaaaatgaaatcattaaagccgatttggaagaattggcgggttacttactgcttttgaagcagaagaatattcctgtaatttggagaccgttgcacgaagctgcaggcaaatggttctggtgggggaaagatgcagcttcatacaaacggctctggaaactcgtatatgagactttcaagcagaaagggctgaacaatcttatctgggtatggactagtgaaacgaacgacagggactggtatcctggtgatgcatacgtggatattatcggacgggacgtgtaccacaagaccagcgctgccggactggcaacggattttgatgcactaaaaaaagctttcccggacaagctgattgcacttagcgaatgtggtgatgtggcaaccatagacaagcaactggcagccggagcccaatgggcatggttcatgacttggtatgattatgaagtgacaaaggacactactgcgcctgtttttaattccggacagcacgaacatgccgacaaggcttggtggaacaacgctttcggccagcctggtgtgatttgccgtagtgatttgccttcgtttaaataacagactattcaacttttatgatgaaatatattattctgactattaatgcgatattttgcctcctcttgccgactgcatgtagcggaagtggagaaaccggtgaaaaaactccggaaacagttgccttgttgcaaaacttgaaacaggcggaacggaaaggcatccttttcggtcatcatgatgatactgcttacggaataggttgggaaggagataagggtcgtagcgatgttaaaagtgtctgcggtgcctatccgggggtgatgtctttcgatttgggcgagattgaactcggaggaacacataatcttgacaaagtatcctttgcgcatcttcgtgaatatattatcgagcagtatgcccgtggcggcatgatttcgctcagttggcatgtacgtaatccgaaaacgggcggtgactcatgggatgtgaccgatagcaccgtagtggcttctgtcatgcaagggggagagaaccatgtgaaaatgctcgaatggatagaccgtgtggccgatttcctgctttcgctgaagacaaaggagggtgtactcattcctgtggtgttccgcccttggcatgaacataccggaagctggttttggtggggaaaggatttgtgctcttcggaacagtacaagaccctttggcggatgactaatgaccgtttgcgtctgaagggagtgaataatgtgctgttagcttactctccgggaatggaatctgatacggttgaggaatatcttgaacgctatccgggggatgatattatagatgttctcggtacggatgtatatcagtttgaacgttcccagtatatcaagcaattgaacaagatgctgacgattctgaccgaggcgggcaagaagcacgataagcctattgccctgaccgaaacaggattggaaggcattcccgattctttatggtggacagggactctgttgcctgtcattgagaaatatcccctcagttatgtactggtttggcgtaatgcgcgtgaaaagtccactcattattatgctccctatcccggacaagtatctgccgatgattttgtgaaattcagtcggtctccgaaaatattgtttgtcggagacaattttgaactctataaataaggaaacatgatgaagaacctgattagaatctgcctgtttactatgcttttgtttgtaacaggagacctggctgcccaaaatatacatttgtcaacccctcgtacctcactggtgctctcggctccggcgggaggagagttgaagtatgtatattatggcagtaagcttactgaaaatgactgtcgcgaagtttataatgcacctaccatgcaacatggggcttatccggtatatggtatgaactgcccgggtgagtcggcgctggcagtgactcatgccgacggaaatatgactttgcaaatggaagtggctggtacggaaataaagaacactgacggagcagttactgctgtcattaaactgaaagacaaggtctatccgttttctgtgaatgtgtgctacaaggcctactccgatgtcgatatcatagagacttggacggagatagcccatgcggagaaaaagaacgttatgttacgtaagtttgattcggcttttctgcctgtgagaaggggagatgtatggttatcaagtctgtatggctcatgggccaacgagggaaggcttgtgcaggaacctcttgaaccgggcatgaaagtgataaagaaccgggacggtgtgagaaattcacatacggcacatgccgaggtgatgttctcgcttgacgggaaacctcaggagaactatggcaatgtcattggtgcagctctttgttatggcggaaactacaaactgcgcattgatacggacgatagtgaatatcaccagttttatgccggcataaatgaagaaaattcagtttataacttgaagaaaggagaacttttcataactccggctttagcattgacttacagtgctgaagggttgagcggatgcagccgtaactttcatcgttgggcgcgcaaatacaaactggcgcatggaaattctctccgtaaaatattgctgaacagttgggaaggagtgtattttgatatcaacgagaacggtatgaaccagatgatgggagatatcgcatctatgggcggtgaactgtttgtgatggatgacgggtggtttggcgataaatacaaacgtaactctgacaattcttcattgggcgactggaaggtggataccgggaagctgcccggtggtatccgtaaattggtggacgatgcccgccaatataaggtgaagttcggtatatggattgaaccggaaatggccaataccactagtgaactttacgaaaaacatccggaatggatattgaaagctcccttgcgcgaaccggtattggggcgtggagggacgcaggtggtgcttgacttgggtaatccgcaggtgcaggatttcatattcaatcttgtagacactttgatgaccaattatccggaaatagattacatcaaatgggatgcgaacatggctattatgaatcatgggtcggactatctgccgaaggatgaacaaagtcatctgtatattgcctatcatcggggatttgagaatgtttgccgccggatacgtgccaaatatccggaactcaccatacaggcgtgtgccagtggaggcgggcgtgccaattatggagtgcttccttactttgatgagttttgggtgagtgacaatacggatgcgttgcaacgaatttatatgcaatggggagcctcttatttctttccggctatagctatggcttcacatatcagtgctgcgcccaatcatcagactttccgcaccattcctttgaaataccgtatcgatgtggctatgagcggtcgtttgggaatggaaatacagcccaagaatatgacaggcgaagagaaagagctatgccgtaaagctattgctgattataaaatgattcgtcctgtggtacagttgggagatatttaccggttgctttctccgtatgacaggctgggggcagcttcgctgatgtatgttgcaccggaaaaagagaaggctgtgttctattggtggaagaccgagcatttttgcaatcagcatttgccgcgtaccaggatggcggggcttcatccggataagatttataaggtgaccgagctgaacaggatagacaaccagcctctggattacgaaggaaaagctttcagcggcgcgtatctgatggcgaacgggctggaaatgccttataatcacaaagtggattaccataagttgagtgattattccagtcgggtactttatctggaagaggttaagtgaatatatataagagaataacgacatttaatttgacgattgatatgattacatttaaagagaagttgaatactctgtttgatgattacaataaactgattaccagcaagaatgtgcctttggaagacggtaacggtattctcacccgttataagtatccgatactgacggctgcccatactcctgtcttctggcgttatgatttggattctgaatccaacccttatctgatggagcgtatcggcatgaacgctacattgaattccggcgctattaaatggaacggcaagtacctgttggtagtacgtgtggaaggtgccgaccgtaaatcgttttttgcggtggccgagagtcctaatggcattgacaatttccgtttttgggattatcctattacgatgcccgaagatgtgattccggctaccaatatttatgatatgcgccttacggcgcatgaagacggctgggtgtacggcattttctgcgcggaaagacatgacccggcagcgccggcgggcgacttgtcgtcggcaactgccactgctgccatagctcgtaccaaagattttgtgaactgggagcggctgcctgatttgaagaccggaagccagcaacgcaatgtcgtgcttcatcccgaattcgtcaatgggaaatatgcactttacacccgtccgcaggacggattcatcgatgccggaagcggagggggaatcggctgggcattggtggacgatatgactcatgcggaggtaagagaggaaacgattattgaccggcgctattatcataccatcaaagaggtgaagaacggagaaggaccgcatcctatcaagactcctaaagggtggctgcatctggcacatggggttcgcggatgtgccgccgggttaaggtatgttctttatatgtatatgacttctcttgaagacccgacgcgtgtgatagcttctcctgccggggcaatcatggttcccgaaggcggggagcgtgtgggagatgtttcgaatgtactgttttccaatggctggattgcagatgaagacggaaaagtattcatttattacgcttcgagtgatacacgtatgcatgtggcaacttctaccatagaccgattggtggattattgtctgaatactccgcaagacggttattcttcatctgcttctgtggaaatactgaaacgccagattgcgaaaaacctgaaattgatgagttgatgcacagcatccttaaataacggtctaccatgataaaactaaaagaaaagattggctacggtttgggagacatggcttcctctatgttctggaagttgttcggctcttatcttatgatattctatacggatgtattcgggatgtctgcagccgttgtggggactatgttcctcgtcactcgtgtatgggattcggcattcgatcctattgtcggaatcattgccgaccgcactcattcacggtgggggaagttccgcccttatctgctatttcttgcttttccgtttgccttcatcggaatccttacttttactactcccgaatggagcatgacggcgaagattgtatatgcttatattacttactcactgatgatgatggtttattctgctatcaatgtgccttatgcttctctgttaggtgtaatgagtgccgaaccgcacgatcgcaatgtactgtctgtctaccgcatggtatttgcctatttgggcagtttcatcgcattgctgctgttcatgcctatggtgaatgcttttagcgagggacatggtgagcaatatggttgggaaatggctgtaactgtgattgctgtcatgtgtactgtcttttttatcggttgttttgctttgacccgtgagcgtgtgaaacctataagggagaagcaagccccgctgaaagatgatttgaaagatttgttgcacaaccgtccctggtggattttgttgggagcgggtattgctgccttgattttcaattccattcgtgacggtgccactgtgtattatttcaagtactttattgtagaaaacagtaatgagccggttacttttctaggtatcccatttgtattaagcggactgtacctggctattggacaggcggctaatattatcggagtggttttggccgctccggtcagtaaccgtatcgggaagaaaagaacttatatgtgggctatggtagttgcaacggtgctcagtatcgttttctactggttcgataaagagaatctcgtactcatttttattttccagatacttatcagtatttgtgccggcagtatttttcctcttttatggagcatgtatgccgattgtgtagactattccgaacttaaaacgggtaacagggctaccggactgatattttcttcttcatccatgagccagaagttcgggtgggcaatcggcagcgctgtcactggctggttgttggggtacttcggtttccaggcgaatgtggtgcaaaatgaccaggctattaatggtatcaggatgtttctcagctttttgcctgccataggtaccttattgagtattttatttatcagcatgtatccgctatccgaaagaagaatgaaagaaatcatcggggaactggaacagaagagaaaccaacattaaacatttaggattatggaaactactattgaacgcctgaaagaggaggtgcaacaagtgcttaccactaatattctcccttactggatagaaaaaatgcaggatagagggaatggaggattttacggtcgcatcacagggcaggaatgtttggttgctgaagcggagaagggagctgtcatgaatgcacgcatcctgtggacgttctctgctgcttaccgcctgttgcataagaccgaatatctggaaattgccactcgcgccaaacgtgaaataatcgaccgcttttatgatacacaatttggaggagtttattggagcatagatgctcatgggcagcctttggatacaaagaagcaggtctatgctatcggatttgctatttatggactgagtgagtatcatcgggcaacggcggacgacgaggctttggaatatgctgtccgcctttttcatgacatcgaattgcattgttttgacaaaggaaaaaatgggtattatgaagcgttttccagagaatggggagaaatagcagatatgcgtctcagtgacaaggatgctaatgaacgcaaaacgatgaatactcatttgcatattcttgagccttataccaatcttttccggatatggaaggatgaaatgctgaaaagccggttgcataatcttatccgtttgttcattgatgagattatggatatggacacaaggcatctgcaacttttctttgacgacaactggcgaagcaattaccatattatatcttacggtcatgatattgaagcgtcgtggcttattcatgaggcggcactcgtacttgctgaccgccaactattgaccgaaatagaaatgtatatcgttgagatggctgaagctgctgcggagggctttctttccgacggaggaatgatttacgaattacggactgacagttcgtctattgatgccgaccggcattggtgggtacaagctgaaacagtggtaggattcatgaatctatatcaacatttcggtgacaagctatctttgtcacgtgctgtccggtgttgggagttcatcaaaaagtatttaattgattatgcaaatggagaatggtactggagcctttcggctgatgggactgtcaaccgtgaggatgataaagccggattttggaaatgtccttaccataacgggcgtatgtgtatggagataatggagcgcttttgatttcattgcaaccgtttagttccaaccctgtttggaactgtttgtttctcggcgtgaaacactttgtttccctgcttgaaacatttcgtttctcggtgagaaacaaatggtttcatggcatgaaacaaatcacggcttgtggggtgacgcccagtatgctgtgggatgactgaagatgacctttaagcaaacttgaggtgtatttataatgaaagctggagaaagggattgttttatctttcctccagcttttatattattgatgagcagtgaattacttcacttcccaagtctcattagtcatcaacagctcctggaaattgtgatatttcttcttgcctttgatttcttcgatttgttcaacgacagcatcattgtaagtcggagcgtctacatcacggattacaccgagcgcaatcgggaagtcgggaccttccatcaaagccagtttcagttgcagtgtattgtcctgacagtgtgcgtcgtggataaggatatctttttctgtgataccgttctcacccagtttcactactttcagcccgaagccttcctgcatcaatccgaattccttgttttcgccgaacaacatcggtttgccatgctccagatagatagcattcttggcacgtccttctttggtggcaacgctggcgtgagttccgtcgttgaagatcacgcagttttgcagaacttctacaacagaagcacctttatggttggctgctgctttcaatacttctaccgaagcggcaccatctactgcaatacagcgtgcgaagaagcgtccgcgggcgccgaatgccagttcagcgggacggaaaggatcttccacggttccgtaaggagaagacttggttacaagtccgcgttccgaagtcggtgaatattgtccttttgtcagaccatagatacggttgttcaacagaatcatattcaggtcgatattacggcgtaaagcgtggatgaagtggttaccaccgattgccagaccgtcaccgtcgccggaaatctgccagatagtcaaatttggattggctactttagctcctgttgcaatagcggctgcacgtccgtggatggtgtggaaaccataggtatttacataataaggcagacgggaagaacaaccgatacccgaaattacggcaatatcgtgcggagctgttcccagttcggccatggctttgtgcagtgaattcaggaaagcgtggtcaccgcatcccggacaccagcgtggctgacctgatttataatcttgtacggtatatactttatcgctcatcttttattcctccaataatttagtgaatgcatctatcaattctctcgtgacgaaaggctgtcctttcacctggttgaactggctgatgttcaatccgggcactttcatgcgcaagtaacctgcaaattgtcccagattctgttcagctaccacgattttcttatatttacgcaacacatcggcagtgttcttcggcagcggattgatgtattggaagtgagcgaaagccactttctttccatgttcgcgcatatagtccatagccagacggagatgtccgtaagtaccgccccagccaacaatcagcaagtctgcgtcctcgtcacccaatacttcgagttcggggatatagtctgcaatcttatccactttggcctgacgcagatgaaccatcttattgtggttttccggttcggtagagataacgcctgtttcgttgctcttttcaagaccaccgatgcggtgcatgaatccttcagttcccggagtagcccagtagcgtacgcctgtttccggattacgttggtaaggagtccagttgccggccatatccggggtcacatacggaggattgatggcaggatattcatccaggttaggaagtttccatgcggcagaaccgttagctacgaaagcatcagtcagcaatacaaccggagtcatgtgttccaaggcaatcttgcatgccatataagcggcgtcgaaacagttggtcggcgatgttgcagcgattacaggcatcgggctttcgccgttgcgtccgtaaagggcttgtaataagtcggtctgttctgatttagtaggaagaccggtagacggaccgccacgctgtacattgacaatcaccaatggaagttcaccgattacagcaaggttcatcgcctcactcttcaggcaaacaccggggccggaagtcgtagtcactgccaaagcaccggcaaaagcggcaccaactgcagaagcacaaccggctatttcatcttcgcactgtacggttttgactcccaatgatttatgtttagctaattcgtgcagaatatcagtagccggagtgataggataagaacccaggtagagccccagacctgctttttcagctgcggcaatcagtccgtaagcggttgctttattaccgttgatatctgtataaagtccttttgatttcggagctttgctttcaatcttataagtagagacagaagcatgagtgtttgctccgtagttgaagccatcgttcaataccttaatattagcttctgctatttcgggtttcttggcgaatttctcgcgcagcattttttcagcagcagcaaggttacggttgaacaaccagcaaaccaatccgagtgcaaacatatttttgcaacggagaatcgatttgttatccaatccggagtctttcaggctctctttgcacatggaagagataggaacttccaatacttcctgttttattcctaattcttcaaagggattgttggttttaaattgtgccttttccaaatctctggcttcgaatgagtcggagtcggtgatgataagtccttgcggtttacagaatttgatttgtgttttcagtgcggaagggttcatagccaccaatacgtggcaacggtctccgggagtgtaaacttgtccggcgccgatgtggacctggaaaccggaaacaccggtcagtgaaccttgcggggcgcggatgtctgccggatagtcagggaatgtacagatgtcatttcctaccgtagccgacacgttcgagaagatgttgccggccagctgcataccgtcgccggagtcgccggagaaacgtactactacttcctccaattctttaaccatcatttcgtctgccataactttaattactatatttaatttaaaaactgattttactttcaatttgtgagcgcaaaggtcggaaagttaatcgaattatcaaaataaatcgaactttattgtcctattgacgccaaatatttgaaatatctgaaaggaacctgtatttttattcttgttaaatcgacagaaaccgttatctttgcaagcaaatttgaagcggccttgtagttcaacggatagaatagaagtttcctaaactttagataggggttcgattcccctcggggctactacgaagaatctgtgagaagttgttttgttttgctttcatatcgtatctggttttgagtttaacaatggcttcttttaagatgaacgtcttatagcttctatttgttttaataatcaatagaaaaagcctctaccgaatgttcggaagaggctttttctatttttggaatttattattcttccgtagttactggtacgacttttttgttcttcatcatgttgtatgcaatcggagatgcaatgaacagtgatgacaatgtaccgataacaacacccaagatcattgcgaatgcaaagctgcggattgaatcaccgccaaggatgaagatacacagcaatacgatcaatgtacttaatgatgtattgatagtacgtgcaagtgtagtattcaatgaatcattgaacaactgacgtttgtcacgtttcggatacaggccgaagaactcacgtacacggtcgaagattaccaccttgtcattgatagagtaaccgatagctgtcaggatagcaccgataaacgtttggtcaatttccagtgagaatggaacgataccccataacaatgagtaagcaccgataatcatgatggtatcgcatgatagagctacgatagagccaatactatatgcgatgttacggaaacggattaagatatacagaccgatagcgatcaaagccagtactacggaatagatggcacctgttttgatatcgtctgcgatactcggacccactttttgagaacttacaatactaccaccagtgtgattgtcacggtcgataaaggtagctagagtgatgttttgagtcagcacaggtttcaaagtctcatataaatatgcttcgatttgagagtcaacatcgtttcctgcatcttcaatacggtagttggtgctgatacgtacagttttcttatctgtaccgatagcgataacactaacgttagcatcaccgaacttgctggagatcaattcacgaatctgttcgggttctaccggattctcgaactgtaccttgaagttacgtccaccggtaaagtcgatactctggcttaaaccgcgcatggcaaatgaaccgatacaaacgaggatgatggctacagtgatgataagggattttttgtttgttcccataaaatcaaaacgtgtgttggtcatcaagtttcttgaaacaggggttgtgaatgtaaggttcaatagtttgtccttgttcatgaagtgttcgtaaactatacgggtcatgaacacagcggtgaagaaggatactagaataccgataatcaatgtcgtagcaaaaccacggatcggaccggtaccgaagttaaacagaatgacacctgtgatgatggatgtcaggttcgagtcgaagatagcggagaatgcgttggaataaccgtcagcaagtgctttcttcacacctttaccggcacgaagttcttctttagtacgttcgtagataagtacgttcgcatccactgccatacctagtgacaacaccataccggcaataccggacattgtcaatgctgcctggaaggaggagaggacacctaatacgaagaagaagttcaggaacaatgcaccattggcaatcatacccggtatgaagccgtacatcatacacatatagatcatcaacagaatcagagccactacgaatgagaatacacctgcattgatagattcctgacccaatgacggaccaacgatatcttcctgtacgatgtgagccggagccggcatcttacctgatttcaatacgtttgctaagtcctttgcctgttcaggagtgaaatgacctgtaatctgtgaacgtccacctgtgatttcagagtttacgtttggtgcagaatatacatagttgtcaagaacgatagcgatagaacgaccgatgttctgtttggtcagctgtgcccaacgacgtgcaccgtcagagttcattgtcatgctgacagccggtttgctgtattggtcgaattcatctttcgcgtctgttactacatcaccttccaacggagctttaccgttgcgttcggtagacttgatagcatataattcgaacgtctgtcctttcttgtcaaattcagaaggagaaacaccccatttcaaacgaaggtctttcgggagttctgctttaacttccggcatagccagatatttgttgatatcagcagtgtctttgtagttagcgtaaccgatcacaggaccttgtccgctagagttcaactgcaggatagccaacagagggtattgctttttaatttctgccaggttagctgttgaattatcttcagtagttgtagcatctcctttcagggcagcagcaagactgtcggcagcacttacgcttttcttggccggagtagcttctgcaagcggagcttctttggtggaatctacagcggtagagtctgcacctgtctcctgcgctaatacagcgcgcaatttagcatcagcagattgcatagcaggaagaacttctttagctgtataagtttcccagaattccaggttagcagaaccttggagaagttttctcacacgttccggctctttgatacccggcaattccaccatgatacgacccattttgtcttccaggctctggatattcggctgaacaacaccgaaacggtcgatacgtgtacgaagtacgttatatgagttttcaacagcagcttttacttctgctctcaatactttttcaacttctgcatccgatgatttctggttaactttgtctttcaactgttgtgttgcgaagagttcggaaagttttgcgttaggagcagctttgtggtattctctgacaaatagcgtgatgatatcatcctgactgtttacagcctgttttgcagcttctgccaatgcattgttgaaagcttcatccggcttgttgtcagccagtgctttgataacatcaggtacagaaacttcaaggataacgttcataccaccttttaggtccaaacctaaactaatctccatctcacgacattgtttcagcgtccagttacccaaccacactttctcattggagagagagtcgaggtagtcttgttccactttcgggtcgccgttcgcaatttctttcgccttgttggtataatggcgtgttacgaaggagaaggagagatagaacacacataccagtgtgagtaataccgcaaaaacctttacaaatcctttgttttgcattttacttttaatttatgatgattacttttttaatttaattttcagttaaattctgtcgtacacaagttctttttgccgcatacaaggctgcaaatatagtttttttttcacattcatgtgtaataagccctcaaatatttgatgtttaagggcttttttgctgaattatttcattcctctgtttttcagtagtggttccaggcttggttccgctccacggaaattcttataaagcaccatcgggtcttcgctgtctcccttctccaatacgttatggcggaacaggtcggcggtgtttttatcaaaaataccatgttctttgaaagcttcgaaagcatcattgtccaatacgttggcccataggtaactatagtatccggctgcgtatccgccaatgatatgattgaagtaagtcacgcgataacgcggtgctatttcgggaatcaagttaagcttgttcatcgcttctttttcgaatgcaagcatgtccaaattctttacatctgtcatcgtgtgcaggttcatgtcgaggatggcggcagccagtaattcggtggtcatgaagccctggttgaaagttttctgttgcagtatcttctcgatgatttcgtcgggtatcacttctcctgtctgataatgtttggcatacattttcagcacttcgggttcagtcgcccaatgttcgttgatttgagaaggaagttctacaaagtcacgtaccacgttggttcccgatgttcctttgtattcacattttgtcagcagtccgtgcagagcgtgaccaaattcgtgaaacagggtttccacttcatccatggtcaataaagagggggtgtcgcctaccggcttggtaaagctgcaaacgttgcataccaacggacgggttgttccgtgttgctcacgatagttgctcatccatgcaccaccgcttttcccgggacgtgggaaatagtctacatagaagataccgagctgggaaccgtctgcgtctttcacttcaaagacttctacatcagggtgataagttggtatgccttccagtttgcttagggtgatgccatataatttgttggctacggcgaaagcgccatcgcgtacattctccagtttgaagtaaggttttgtatcctcttcagacaggttgtatttttctttccgtagtttttcggtataataccaccagtcccatgcttctagtttttctccttttccttccttatccattaatttctgaagttcggtagcttctgcttttgcttttggcagtgcgtagctccagaggttatttaaaaggctcattacgttgttggcgttctttgccatggtttcatccaggacgaagtttgcataacagtcgaaacctaataagttcgctttttccaggcggagagaaacgatcttgcggatgttttccttgttatcgtttccgtcgttgttgttgccgcggttgatataagctttgtatatttgctcccggagcgggcgattttcagaatattgcaggaaaggcagacggctggcattgtgcagggtgaacaaccattttcccggttgtccggctgctttcgcttcttcggccgcactttggcggaaccattcaggcaatcctgccagatcttcttccttgtcaacgaaaagttggaaggcattattctcattcagcacattgttgctgaaagtgatgccaagtgtagaaagctccttgttgatttcgcggaggcgagtttggtccttttcgccaaggttcgctccggaacggataaatcttttataagtcttgtccagcagacgttcttgttccgacgtcaggttcaatgaatctttcttttggtagacatcgttcacccgtttgaatagtttcccattcagggagatattgtcattatgttccgaaagaaccggtgccagtttgatggaaagtgcggtcagcgaatcagtagtttccgcatctgtcatattgaagaaaatgatgcttacccggtctaagatgggtgcgctgttatccaaagccacaatcgtattttcgaatgtcggaatttccgggctttcgatgatggcttcgatattttgattctgttcttctataccttttagaaaggcaggttcatagtgctctaatttaatcttgtcgaaagaaggaacaccatactcggtttgaaactctgtaaagaaaggattgctttctgttttcgtagcacaggagtacatcatacaacttactgctaaaatggttagtgtctttttaatcatcataagtgttttttattagagttttcagttcttatcgtttactgatatagcaccagatcgggtaatggtctgatgccttgatagaccggtctaccgtgcaattgtaggctttcaggttggggctgatcaagatattgtctatgcggaaatagaacttgttctgattgtaggaaatacctaatcctttaccggactgtgtgaatgcatcatctagtttttgagtcaggatgcgatgggtatatgagatagaaccgtcgttgaaatcgccgcatactatggttgtcggatatttactttctgcaatggttttagccacagaatctgcttgtgtagcccggatagccgatgcttccgccagttttcttattaattgcctaagtccggtttttactttcttggcattcgggtctttaatcatatcctcatacatccctctgtcttctttggtgagcttgttggattccaggtggttgttgattaatgtaagagtgtcgttattcacattcagtacatatttcatggagccgttataattactttcatattcgatgggatgtatcgagagtatggggaacttagagaaacaggcaagttgcacgtctcctttcccttgttggtggacggattggtaaggataggctttcaatgcttttttaatgtcctgttccgtcaggtatttcttgttggtagcggtgttatattcttgcagacagataatatcggcgttactatctacaagataagacaataccgggttttttccatctttcttctccaaattgttgaaactcattacgttgtaggataggattttgatgcttccttccggtatgttttttgtggtggagttaaaaggaatataagtccgtatctgcggaatacaaattagaaaaccgatggcaggcaagagcgcatagcggtaattgacaaatgcccagaagccgataaaaatcagattaatcgtcaggaatatcggaaatgcaagtcccaagctggaagcaagtgggtttattttcgggttaaggtaagggctataagcgcttaatatcaacgttcccacgaagagagcgttgacagcaagtatcagatatgcgacaaatttgccaatatgttccattcttttatcttttgcttgcgtcgaacaagcttttcttttcttcagttgtcagactgtcgtaaccggatttctttagtttttccaaaatacggtccacttcatcagactgtgcttttttgtgggcattgtaatcataatccttctcgcgaccggtggcactgtttccatagtgtaccttcattttcggtttccgtttccatgttttcttttgaaacaaggaagtgaaaccatccagaatccagttgatccaggaagtcaaatcagttcctttacttaggctggcggcaaaccaaagtcctgcaagagcaccgcccaggtgggcgatatgtcctccggcattacttgaggtgatggataatacatcgattccgataacaaccagtgccagatatttgagacggatagcaccgaaaagaaaaagttgcaccctgtaatatggttcacgataagccgtagcggctacgatggctaatacggaagctgatgctcctaccaatgttgcacccgtcacttgcgaactgaataaaggaaatacattgtaggcaaccatatacagtaaacctccacagatacctcctaatacatatagtcctcttaaatgtttggccgagaaaaagtagagaaacaaacttccgaaccaatacagccagagcatattgaataaaatatgcaggataccggcatgcataaacatataagtaaataacgaccacggctgatgaataaatccgataaaggatgccggcagggcaaatataccgaatatatcgggggtacttacttcaaacagtcgcaagaaaacgttaatcaacgtgccaatcacaaagatgcctacgttgatataaatcagttggatgaaaatatttcctcttctgaatgtctcctttaaatcagctataatatgtcccattgttattgcttttttttctccaatacaaaatcaggatcaatccaaataacattcctcccaggtgagcaaagtgagcgacattgtctccggcgctattggcaagtcctgaccataattcaatcgcggcgtatcctataacgaagaacttcgctttgataggaaatggcagcgggaagataaacaaccggttattgggaaataacataccgaatgccagcaatatggcgtaaacggctcccgaagcacctacggtggtcatcatgttcagatactcttctatggggacaacgccatagcctattaggttaatgtgcgtatgttggctaagctccgttacatattgaatatactgcactccttcctggataagtcccgcaccgataccgcagagaatatagtaaaagaggaaacgtttgggtccccaggtttgttcgagaatcggtccgaacataaaaacggcaaacatattaaagaaaatgtggctgaatccgccgtgcataaacatataagtgataagctgtgccggattaaagtcacttgcaaggaaaaaatgtaatcccagataattcgttaaatccaggccgtaacgttgggctacgattgtcccgaaaaatactagtacattgataattatcaggtttttagttacagttggcatcattttaatttctgaatatttagataatagacgcaaaagtacgaataaattctgttttaaagcatgaaaaacgcttcctattagctctttttcaataatttgctgcgttttttttatgtttttatttgatatgttgttttgttcggctatatttgtggaatcaatccattgtgggataatcttttgtgtaacatatatattaattaatcattttacgtattatgaataagtctgatcttattagcgcaatggctgctgaagctcaaatgagcaaagccgatgcaaaaaaagcacttgatgctttcatcacttcagttactaatgctatgaaagctggtgacaaagtatctctcgtaggttttggtactttctcagtaagcgaaagagctgaaagaactggtattaacccttctacaaaggcaactattactattcctgctaagaaagtagctaaatttaaagctggtgctgaattatctgcagctgttgaataagatagatagttgaaagaaattaagagaggagacgtgatgcgtctcctttttttgtatctttgcgcgcaagaaataacttgattatgaagatagaagataaacttgtagcgtccgttatcagcggactcaaagcactttacggtcaggaagtccctgaaaagatggtgcagttgcaaaaaacgaagaaagaatttgaaggacatttgacgttggtggtatttcctttcctgaagatgtcaaaaaaaggaccggagcaaacggcacaggaaatcggtgaatatctgaaggcaaacgatccggctgtagcagcgtttaatgtgataaaagggttcttgaacctgactattgcatcggctacatggattgagttgctgaacgagattcaggcagatgaacagtacggcttagtgcaggtcactgacgcttctccattggtgatgattgaatattcttctccgaatacaaataaaccgcttcacttgggacacgtgcgtaataaccttttaggcaacgcattggctaacattgtagcggcaaacggcaataaggtagtcaaaacaaatattgtaaacgaccgtggtatccacatctgtaagtccatgctggcatggaagaaatacggaaacggtgaaactcctgaaacttcgggtaagaagggtgaccacctggtaggtgattattatgtatctttcgataagcattataaagcggaagtaaaggagctgatggctaaatttacagcgcagggaatgaatgacgatgaagcgaaagcaaaggctgaagctgaatctccattgatgcaggaagcccgcgaaatgttggtgaagtgggaagccggtgatccggaagtacgcggattgtgggaaatgatgaacaactgggtatatgcaggattcgacgaaacctacaagaagatgggtgtcagcttcgacaagatctattacgaatccaatacttacctcgaaggaaaagaaaaggtaatggaaggtctggaaaaaggtttcttctacaagaaagaagacggttccgtatgggccgacctgactgccgaaggactggatcataagctccttctccgtggtgacggtacttctgtctacatgactcaggatatcggtacggctaaacttcgttttgccgattacccgattaataagatgatttatgtagtaggtaacgaacagaactatcacttccaggtgctttctatcttgctcgataaacttggtttcgaatggggtaagagtctggtacacttctcttacggaatggtggaactgccggaaggtaagatgaaatcccgtgagggtacggtagttgatgctgacgacttgatggaggaaatgattgccactgctaaagaaacttcacaagaactaggcaaactggatggtttgacacaggaagaagctgatgatattgcccgtattgtgggtctgggagcattgaaatatttcattctgaaagtcgatgcccgtaagaatatgacattcaatccgaaagaatctatcgacttcaatggtaatacaggtccgtttattcaatatacttatgcacgtatccagtctgtacttcggaaagctgccgaatcaggtatcgtaattcctgaacagattccggctggtattgaattgagtgaaaaggaagaagggctgattcagatggttgccgactttgctgctgttgtaaaacaagccggtgaagattacagcccgtctattattgctaattatacttatgacttggtgaaagaatacaatcagttctatcatgactatagtattctgcgcgaagagaatgaggcagtgaaagtattccgtatcgctctgtctgctaatgtagctaaagttgttcgcttgggaatgaatttgctgggtatcgaagttccttccagaatgtaagactttctctgaacaaaatagacttctgcggggtttcttttatatatataaaaggaacctcgtatgttttactccccccatccattgcttcggaagagagaaacggaaactgctactgtctcttattccgaactgctgtttgacctgatttatgttttctcggtcacgcaactttcacattatctgcttcataatctcacttgggaaggattattgaaagaaacaatcctgtggtttgcagtctggatgttgtggcaacataccatctgggtgactaactggttcaacccggatacccggccgatacgtattcttctttttatcagtatgctggtggggctggtgatggcggctgccattccttatgcctttacttaccggggattgatatttgctgtctgctatgttctgatacaggcagggagaacactttatattatcggggtgttaggagatcatcatctggctgctaattttaagcgaattatgggctggttctgtatatctgccgtcttttggattacgggtgccatattgcagggagaatggcaaattctactgtggattatagccgccatctgtgattatacagccccgatgcacggatttgctttacctcgtctgggacgttcggacagtagcaaggaatggactattgaagggcatcatttggtggaacgttgccagttgtttgtgattattgcttttggagaaactctattgatgacaggagcttctttgagtgaagtagaagaatggacgcctctcgtgattatttctgctgtcatatctttcattggtagtttggctatgtggtgggtttactttgatgtgagcagtgaagccggtagccggaaaatacaggaagtgaaagatcccggcaagctggggttgatttataatgcaattcatatcgtactggtgggagcattgattatttgtgcggtaggagacgaactgattgttgcccatcccgaacaagaaatgagagcggaagttgtttttgttctgattatcggaccaatcgtttatattctggcaaatagtatctataaatatgtcacgtgccgtatgcttcctttatcacatattattgctgtaatagctttggctttactgcttccctggccttatcacatttctttattgacgatgaatatcttggtaacatctgtttttatattcgtgattgtgtttgatatgctattccctaataaaggttttaagataaaatgggagccgaagatttaatgatgaaagcctattcataacggataatacttatatcctataatattgtggcttaaaataaaaacacagttcacacgaattcttggtgagtattcaagaagttgtgtgaactgcgtaattcgcgcctttctaaacggatgtctattatgtctttttcatcgatggttcgcaatgcgaagtcccgatagcgattccgtacaatatccgggctgctcttatttaaatcgtatcaatctttatttgtaccaatctttattttgtttcccattcgatgatacccatccagagaacttgggatatgattgatcgattcgtttcccttcctctggaaccgggagattacttaccggcatattgatagcaaacggcatcaagtctgcagaaacataatacatcccttcttctggtctgtagatgtcttttccggttcccagtaacgataagtcggctttatcagtcgggggataatttatcagatgtaattctttgcctctaccctcgttggaactgatgaagataaacgggttgtaaggaggtaccacctctttctcactagctccatcaagcgtgatggttacagtatattctttctttgattcatcagtgatatttttgaattttgtcatgtcgtcatacaacaatatggttgggtgagactgtccaggctctgtttcttttccttccatgtatatagaacttgataaaccactggcatcaggccccgttatttttacactcttgatattgctgtttgagagctgtgtaattgatatccaaatccgttttgcagataaccgccacagtgctgtaagataaacttgtcttctatttcgtaaatgcgattgtcaagagcatttcgggtcatcgtactggtgtactttaccattacgtcattcatatcgtaatcacctaacttaggccataagtcttcaaaagccagtgtaccggaataggaaattttatattgctcggggattgcttcggggtcctcaggcagtgcaggcaatgccgggtcaatagcattcttttctgacgtatgaatatagaatatggcatctgcataatcgaagtcaatattatcttcgaatcctactgctacaatctgcccggactgagaatcacggagagatatggtcctttgtgtattattcgtgtttagattcctggtagagtagcgtggccccataccttttatgatatcgcccactttgtctttatctgtttctgaggtgagtttgctcttgaatcccataccttgaaggcaccagccaattgtgactcctgcaggaaatttgtcttcgtattcctgtgtctcttcattccaatatttgagttttatttcttctccacacactaatgctcctacccctaaagtcttgtaaacaggagaggtgtttgggaatgcaattatttgttttatatcactcgcgctctggggtggattgttggtcggataggtgtaatatccaactgtattgtaccatgcagcagagctgtttataaatacaaggctcacttcggtcgggttaacaattggaatatctgaagtcattttaatggaaccatcaaaaaactccggataattctgactgatgttcagaaccttgcttttaccgttttcatctttgactgtaacctttctgaaaacatacttgatgttgtataatacgtctgccggaggtatgtttattttaggctccagattggttggtcttccgttgttatcccagtctgcatcgggaagaacatgccattcttttagataggtatgttggttcacggtcactcctctggtttttgatgccgtttgtgaacgtaaggcagtgatatatgcatcttgattaaatgaaagccgacgactgtcgtcaatcgttagttttagaggagatgcggtggctaaataatccgatgataaccatacttccgagatgtccgccgggatattcatctctccgctgaatttgccttcttcgtctgtaactgcacgatagataggctctatgtccttttgggacacggtgccgtcagctgagtattcaatgggatcttgatcgtaaatgtcaaaaaggacacgataattgtcgcttttgaaacaataattgatattcaaagcaacggcttggatcatgttgaagtcgaagtatgcttcttttggcatatgccttctctcccaggataagtcacgctctttatccatgcaactgatggaagatatgacaagtactcctatcattaaatactttaaaattgtttgcttcataagtttgtgtattaaaagataaagagcaaatatatacatttaattatataatttgctctttttctagtttttttatttcttttttgcgaatcgtcctttttttgtggtcgctggtcctttttcatcttgtaatttgatgagttccaaacagctagctaaactcaaatcttgtgggacgatatctttaggaattttataattggaacccttataggtaatataaggtccgtaacgtccgttcagaatctcaagttccggctcctcttcaaacgtcttgatgtggcgttccgcttctttctggcgtttctccagaatcagctgttcagcctcttccaaagtaatttccatcgggtcaagtgttttcgggagcgatacatataccttattgtgcaggacatacggaccgaaacggcctacacctacacttactgattttccttcatattcgcccagtgtacgaggtaatttgaataattccagtgcttcttccaaagtgatggtttccatggattgacctttcttcatttgtgcaaagcgtggtttttcttcatcttctacagtaccaatctgtacaacaggaccgaagcggccaatcttaacagaaacagtcttacctgttcccggttcttctcccagaatacgttcgcctactttatgttccgtcttgattgccaatgtattttctacagacggatggaacttatcatagaaattcttcatgatagaagtccatttcacttctccttctgcaatctcgtcaaattccttttctacgctggcggtaaagttgaaatccagaatgtccgggaaatattcggtaaggaaatcatttaccacagtgccggtatccgttgggaataacttcgccttttctgcaccggtaatttcagtatggttttcatccttaatctgacgatctttcaatgtcatgacattaaactgccgttcttccccgtctttattacctttctccacatattcgcgttgttggatggtagagatagtaggtgcatacgtagacggacgtccgatacccagttcttccaacttgcgtacaagacttgcttccgtatagcgtggaggacgttgggtgaaacgttcggttgcgatgatagggccgtgttccaacttctgaccttttttcagaggaggaagtaggtggctctcatcttcctgttcgttgtcatcatcataagattcacggtatacacgcaggaatccgtcgaacttaatcacttcgccgatggctgtaaatacatcgctactgccacttattgttatggtagcagttgtcttttccagttccgcatctgccatttgtgaggcaatggtgcgtttccatatcaagtcgtacagtttcttttcctgtgctgttccttcaacagactggttttccatataggtaggacggatagcctcatgcgcttcttgtgcacccttagtctttgtttcgaaatgacgggggtgtacgtagcggtcacccatcattttgatgatagcgtctttactgcctgctgtcgcaaattccgagaggttgacagagtctgtacgcatataagtgatgaatcccgattcgtataagcgttgcgcgagcatcatggtctgcgctacggtatatcccagtttgcgtgcggcttcctgctgcaacgtagatgttgtgaatggagcaggaggtgttttcttgaccgggcgggtagtaatatcgtcgatggcaaagcttgctccctgacatgcgttgaggaaagcttttgcttcttcttttgttttaatacggcgagccagttcagctttcatctccaccagttttccgtctgtgtccggaacgaggaatacggcagtgatgcgataagcagcttccgtttggaaagcatgtatttcacgttcacgttcaacgatcaggcggacagcaacagactgaacacgtccggcagaaagtgccggtttcacttttctccaaagcacgggagagagttcgaaacctacgatacggtccagaatccgtcgtgcttgttgtgcatttacgaggttgaggtcaatgtcgcgtggttgttcaatcgcttttaaaatagcgcttttcgtaatttcatgaaatacgattcgttttgtgttttccggttttagttttaagacctcatacagatgccaggcaatcgcttctccttcgcggtcctcatcggatgcgagccatacggtttctgcgtctttagcttctgtcttcagtgtgttaaccagagcctttttgtctgccgggatttcgtagctgggtgtaaaattcttctctacgtcgatgctgaattcttttttcttcagatcgcgtatgtgtccgtaactagaaaggactttaaaatctttcccaagaaacttttcaatcgtttttgcttttgccggagactcgacaatgacaaggtttttctgcataattctttcttttataatggcttgtaccacaatattcggggacaaaagtaaaaaaaaagattctccctaccttatattataaggagaatttaataaaatcttaagatttaccagtgttgatgtttactcttacatctgtaaatcttaagatttagcttaatgggaggatgcttgccggcttattttgttgcggatgaggggtcttcctttattttcttgagaaattccgtcggcaacatgccgaattgcttctggaaacacttggcaaagtaggaagaagaactgaacccgacgaggaatcctatttcggtaacccgatattctccctccaccatcattttgcaggctttctttaatcgagtgaccttgatgaaatcattgggagtcatgccaataatgcctttgatcttggtaaatacagaggtacggctcatttccagttcctgtgccagtgtatttaccgaaaattcggagtcctcaatattattctggatgatttcggtacatttattcataaattcttcatccagtttattgtggacagcggagtgcagatcggacaacggagtagaggcatacgttttctgctgactttcccttttcttgagtaagttcagcaattgtgctttcaggtggaaaggtgagaatggtttctctatatatgcatccgcaccggcttccagtcctttgattttactttccgtatccgttttggctgtcagcagaatgacaggaacatgggaaatattgatgttacttttaattttcccacagagttcgaacccgtccatttcctccatcatcacatcactgatgatgagatcgatgttgttcttttcaagaatttgcaacgcttcctctccacttgaagccgaaatgacgaaatattcctcggacagaattttggaaaggaaatccagaatctccgggttgtcgtccacaaccataatggcatattgttttttcaacggttcaccgggaagagtgctttccagttcattttcttctatgctgttttctggaataatcgtatcttccactcgtttggccacttgtggcaaagcagtgatggccgcttgtttggggaaatatacagaaatagaaacaccgttttcaccgccttccctatcgctgacttcgatctttccgttcatcaattggacgagtgagcgtgtcatgtgaagcccgataccaatgcccagtttatttatttcactgttgttcttaacctgatagaatgcgtcgaatattttagtcttttcttgatcggtgatgcctataccgtcatcggtcacggtgactactatctcggaatccttttctatagtcgtaatacgaatcgtgcttttggcatatttcaaggcattacttagtagattgctgataatcttggtaaaagcttcttcatctatgacaatgctcagttcttccgggatagaagaagtgtcaatcgccactttcttttgtctggcagataattcaaaaatgcagcttactttgcagattatttctttaatccggtaacagtcatacgatagtttataagatcccgtatctactttgcggaaatccagcaattgggtgacaagcgcatacaagcgtttgtaattctgttcaataatacttaggtattccccatacacattgttgatacttgaagttttcatcaggtattccaatgggccgataataaggctcaaaggagttcgaatctcatgagcaatgttagtgaagaaatctattttggagttatagagctctttttctttttcatcgttcagcctcttgatacgttctttctgacgtttctccgtgcgttttacgtaataccatacggttaacataatcgcaatcaacaggacgagggcatagatcagataagccagttgcgaccggaagaatggaggcagcaccttgatttttagctgtacttcattgctgctccatagtttatcactgttcgttcccttgatccttaatacatattcaccgacgggtaagtttgcataggaaagatggttgttacttcctttagtgaactgccattcgctgtccagaccttccagcatatattgataatcattctctttgggagcaatgtaacttagtgcggcaaaatcgaatccgatcatggactggttatatttcaacacaatctcatctgtatatcctatggactggtgaataggtgaattgggcgtgtcagcctgtatgtcttttccgaaaatggtcatattagtgaggatgacaggtggattgtatgtattttctctcaagtcttgcggaaagaaatagcagaaaccgtctgtcgaacccagaaatagtctaccgtcagaagattcaaagccggagcagggtgtgaattgttcattgtatagtccgtttgatttcgaataggtttttagatattctgtatccggattgtatacagcaagtcccttattggtactaatccataataagtctcctttagggataatggaagtgatgattttattcggcaactttaggtagtcgtatctggtaaaatcatctgtttcatcattatatctacaaagtccttgcccataagttcccacccatagtcgtttcttgttgtcgatagctagcgtggtgattacattctttgttagtgaattcggatggtctgaacgttgataagatgttatcttttgggttctgacattgtatgaatataatccactgatgcttgttcctatccatattcttccgaagtaatcttcaatgatatccgatattttgcctgtaaaagaaccgattctgatgaaattgtttttttcggggttatagtaacagaatcctgcagaagtgcccacgtaaatacatccattactggctttatatagagtgaatacccgtgaggaggggatagatgttgaatcttccggattattgagaaaactttccacttttcctgtttttaaatcaatcacctccaaacctcttccataagtggcggcatatagtttatctccgtctaccagcagatcgtgtatacaatagtaagttgtgcctatactggctgcatcccggaaaggggtaatttcttgagttttggcatcaaatcggaaaatgccattgtcatccgtacctatccagtatttatcatctttgtcttctttgataacattgattacttttcctgattgtggcgtggacgatgatgaacagctataatatttgaaattattctgaaatgccgaatagaatttgattccatcgaaataggagcccagccagaggctttcttccttatctatatagatggtatatataaacttattggctccggttcttattttcagattcggattgtcggattgtataatttctcctttgtctgctttaaaaattcccataccgttgtcggatgaaatgaacaactcgccaggtctgtattctttaatgtcgtggatatgatataataggttgttcggacttctgtcccggtagttggtgaaagttttagccacaggatcgaacaggtcgagcccgttctgaaaagttcctatccataaattgccgtgtgagtcttcaaacactttctgaatggaattatctgataaactattagggtgattgctctttttgtaagtgacgaacgtgtttttctgtttgtcaaagcagcataatccttccgaataggttcctatccaaatgttttgtttactgtcttgctgcaatgtcatgataatgttttgggagatgctattaatctttccgggaatattccggtatactctaagcctgactttatcagatggagaaaaacggtaaagcccttctccactcgttgcaatccatacttctccgtcactgtcttctatcatatcggtgacgtaggtttgtatcatttctccagtttcagttttggcatggaaaggttggaaagtgtctgttttcgagtcgtaaatgacaattccggtatccaatcctatccacattctgcccctgcggtcgataaatattttcttgacgctgttactggttgttgcgttgatatattctgatagatagtagttcttgaatgcaataccgtcgaatctgcttaatccatcatcggtaccgaaccacatgaatccacatgaatcttgcaaaatgctgtatactctgttggctgccagtccatcatccattgtataggaggtggagaagatacgctgcgcattcacgacaaatgaatgcatgcacaggatttgtatagttatcaaaagaacgatttttttcatgggggattctttatgttgtattagttttcattagtataggacaatattaggaagaattagtagcaaaagcaaatgataggctgtctttttaggtgtggaataaaacttttgaaagtgaacaaaaaaatcgttcaaatcttggataattattggttaatatggttgtgggctttgggataattcattagttgaaattaaatctcgctttgcatagattagtatctgtatattctatgtacatttgtctcgttagcatatcggttttcgtttgacttaagttaaacgaaaggatgacttaagttgaactatcgcctgacttaagtcaaacgaaaataggaatgcgttttagaaaattaatccataggagagaggaatttaatctttcctattgaaaaactaattgataatgagtgtaaattatgatctttatgaaactcccgatcttgctaaaagtggggaagaacagcctttgcatgcacgtgtcgttttgaagggcagttatacagccgaagaatttgtggaacaagtgaccgtatttcagcatatgccccatgcacaagtggtcggcgttatagaagctatatcaaaagaactacgtcatttgcttttgaaaggattttcggtagagctgggcgatatcggttatttctccctttcattgagtgttgacaagaaagtgatggatccaaaagacttgcgttcaccgtccgtatctctgaaagatattaatttccgtgtcaatcggcagtttaaaaaggatattgagagtgagattgaattacaacgttatcattctccttttcgtgtgaagaaccccttggatagggagagatgcttacaacggttggaaaagttcttggaagaccatccgtgcatcaaccgtcaggattatgctatgcttgtgggaaaaacgaagatacaggcattgcaggatatcaatgcttttatcaaagatggtgtcttgaagaagtatggttcagggcgttctgtagtctatataaagtaggaattggtatagtgacggtatatgtatggaatagcgtcactatctagttggtataccgtcactatatcgaaaggataccgtcactcttttgaaagatgtttctgcttccgtacaagtgtcagcgaatgtggggagcggaagtaagacagccaaatatattgtaggcaagcaaattttgcaggcaactattctattctgtagaaatatgggacagggcattctgtggtatatataaaaagcgacctgatattttataataattcaggagtctattataagaggggattctttggaatatcctcttttttgtgacttccggataaatttagtataaaattaaatattcaatttttctttttacgatattgttgctcttttgtacataattagccttgttaaagtgttctattgcatacttttgtttcgaaaaggataaaaacataagttaaccttactggagtttggcaatagcggatgatattctggtaaaacgtattttatcagggtatcaactgaattataatacggtataaatctaaaagaaaatctatgggtattctaaagtgtatattaatagcatgcagttgtctggtttgggcgactcatgctttttgtgtggaggtgaaagatacgattgagtatcgtgcgcaagtatgggtggataaaatcgatttggaacgttatggcggagaagcatcttttaaaaagaatttgcagcagatgtttcataatacaacccgcttttggaatgaaagtcccaataagtttaactattatttccggtttgttcctgctgacgaattgtgtgtgtatgatattcagggagataaagacagatacggagagtttcagagaaaggctttcggtcggcttgatttgtcgaaatatgactttgtgttgtttctggcgttgggcgcaaagaatgaaggactatcttgtggtggcggtggagccagtgggcagtcggtggtgatgtgttatgttcgtgaagctcataacatttttacagatgcgctatatcccgatcaggggacatatagtaatctagggcacgagtatggacatgtgcgtggtgctacagatttatatcaatatatgattgctgcagaagataatccggtaagtcatgagaaattaactcctcctaaatgtaatatggggactggatatcgcgtctggagtgattattgttcggctttattcaattatacagcaaaaatgagaccactggataaagacttgtcggacaaagtctttcctcgtaaactagtgattaaagtgggtaaaatggggaaaccgttatctaattgtacagtgaatttttatggaactcgtgccggtggtaaatataataagcgggatgtatatccgaaagcttacagaacatacactaccagtaaacgaggcataattgagataactgatttgtataagttgtatcatccggatatgacagatgccaatattcctcccaaagaaccacaagatttattcccatattcttattggtttagttttctagtagaaataatagatgaggtgggacaaaagaaatatgtatggcttcctgatgtggaactacagagagagcatttggaaacaggtaatgatacttatacggttaatgtaacattttaaaagtaaagtaatatgtgctgtagtaagcgaaattttatctatttgttttgtggattgatgttggcccttaatatacaaatgttgcaggctaagttgggaaataaaattatttttattccggaagatgatcttaaaaagcacggttttgatgttcctgatggtagatttggctatgattgtatggcagaatctgataatctagttattttctgggagaggtcttttggcaaggaacctgctgtaaacatggatgagagtaaacgattttatccgaatgaaatattgagtgagggcgaacggtactatcgttattttgtagacaaattgaaatttgtgcagaaagggaaatcttatactgataagtataagatgattatatggatgtatgatgacaatgagaagacagtctatggtggtgctcatgacaatgtcggaatgacctggtttcgtccgtgcagaataaacgggtatccttactgtacacttgctcacgagttagggcattcttttcagtttatggttgaggcagatggtggcaaaggatttccggggacgacactctatgagtatacttctcaatggatgctatggcaggtacatccagactgggtgactattgagaattatcatttgaataattacatgaaacagacacattatacattgtttcataaaacgaaccaatattgcgctccgcagtttatggagtactggtcttataagcatggattgccggtgataggcagaatgtggagtgaagctttaaaagaagaggacccagtgtccacttatatgcgaataacgaagacttctcaagatttgtttaatgaagaaatctatgatgcggcaactcgttttgtaacttgggatcttccccgcataaaatcagtttgtagttcttatgctaatgagcatcgttgtaaattaaagaaaatggggaacggatggtatcaaataacaaaagaatattgtccacaaagttatggttataatgcaattagattgaaggttcctaaaggagggacagtcatagacttgacttttgagggaatggctggaaatgaaggtttttattcggaaaataaggcgtatgcagggtggcgttacggctttgttgccatgcagaagaatggaaagagagtttatagtaagatgaatagagctgtaaatagcgtgaatcaaactgttaattttatagttcctgacgatacccagttcttgtggcttgtcgtgacaggagcaccagataaacatacgaaatatcatcagaaaatggagcaagttgctgaatggccatatcggataaagatcagtaagacttcatttcatccagatactttgtaatggaatgattgaagtatctggttatggaggttattatttgagatgggaaaagtgtggtatcggattgaaaaatatgataataaagtacttgatatttattctatttagatgaaagtgacctgatagtgaaaagagatttgtttgtagaaataaaatatgagcaataaaatggtacatgatctaggataataattggtgaaatacagagcagtaagtgaaaagatctcacgttttactatattgttgttcttttgtacgcaatttgccttggttttactggcatacgtctaccttagtggcgcagaagatgatttgattgttttttaagactaagctatatctcttttgtattaaccttattaatcttttataatactaatatttatgagttgtaaattatctttcacgttgttatgtatagctatgttagcttcttgtatctccactaaaatggatccaccgcaaccgtatggggtattgcctacagatcgtcaactagcttggcatgaaatggaaatgtataatatgattgaattcaatcagaacaatgcacttgatattcattggggatggggtaatgagtctccggaactagtgaaccctgtagattttgacgcagaaaaaatagttcttcttgcaaaaaaaataggttcgaaaggatttctcatcaatgcaaagcatcatggtgggttctgtatgtggccaacgaaaaccactgattataatatttctaaatcaccttggaaagatggcaaaggagattgggttggcgaatgggcgaaggcttgtcgtcagcatgggcttaaactcggactttacttatcgccgtgggatagaaatgctgcatgtttcggaacgcccgaatatctgaaaatgtataaggaacaactaacagaattgtgtaccaattatggagaactgtttactctttggtttgatggtgctccaggtgccggtggttcgggatattacggaggtgctaatgaatatcgtggcggattcatcgaatattatgactgggataatatttatgcgattgtcagagaactccaacccaacgctgtcatttttaatgaccccggacctgatatccgttgggtaggaaatgaggatggatatgccggaagatataaaaaaacttgttgggcaacattattccctgaaggaaattggaacatgagaccacgccctaatagtgacggtgagcggattaaaatgttgaatgagggacaacgacatgggaaatattggattccggcagagtgtgacttttcgctaaaaaggcgttttgcttatcatactacagatagcttgactactaaaagccctcaaaaattatttgatatctatcttgcgagtgttgggttggggcagggatttgatatgtgtcttcctttaactccaaaaggagtaatggagtggagagatgtcaaatctttggaaggtttcgctgaattaatgaataaaacttttagcaaaaattttattaaaggagcacgtttggtgccatctaatgtgcgtgggaatataactaggcattatggtactgcaaagcttacagacaatgaccggtattcttattgggcgactgacgatacagtaacaaatgcatcattgatgatagaacttccaaagaaacaagtttttaatctgataaaagtgcgtgaaaacataaaattaggtcaacgaatcgactctatgaaagtcgatgcttgggtagatggtggctggaaagaaatagcagaggctaccagcataggggcgtgtcgaattattcgtcttgagaatgatttgaatacagacagaatccgtttacgcttttttgccccagtagcattggctgtgagtgaagtaagtctgtttaaagaacctgataatttagaagcaccaaaaatttatagaaagaaggatggaatggtgagtataagaacagaccggcctgtaatttctatccgatatacaacagacggaaccgaaccgtcatttacctcaaatgagtataaagagccattcctttttgataaacagggagttgtaagagcggcagtttttacatctgataaaaaaagtggagagattacttcagtgatttttgatcagtgcaagaagaattggaaaattatatcacctgttaaatctggtgttgataatatgattgatgataatgtagagagttacttccatacgtatgatgctggtaataagaaagaatttgtacccgacgaggttattgttgatatgggaactactattcctgtgtccgagatcatttacacaccacgtcaggatatgtatagaaatgtggatggagtcattgaaaattatgaaatttatttgagtgaagatggactgaaatgggaaatggcttcaaagggtgtctttcagaacattaggcagacacttgtgcctcaagaaattaagttaaataaggtttatcggtcacgttatctgaaatttgtggtcaatggtgtgttggagaagaattttataagtgtagctgaaattggagtgcgaactgttgactaatttctttgtagtgtagaaaggaatattcgcttttgatgagcattgtgtaaatacccctttctgtatgtgaataaaaaatgatttttgggtgataattgatgaattttaaatttaaaaaatatatagttaactgatgtctaattttataagaaaaagcttatgaagtattatttaagaaggattgcttttgtaacgttgggagcttttatagttgccggcactacgagcctaccggcgatagctgactccggagttaagggggcagtgtctgctcaacaacagcaaagcaaaagacaagtaacaggcactgtcacggacgctttggatggcagtcccattattggtgccaatattgcattgaaaggcactcaaacaggtgtaatatcagatttggatggtaattattctattccagttaatagtaccaaagatatcttagtcgtttcttttattggctataaaactcgggaggttcctgtagagacttcaggtattatcgatatcaagttgacttccgataatgagatgctggacgaagtagtgattgtcggatcgggaacacagaaaaaagtaagcgttacgggggctatttctaccgtgaaaggattggaacttaaagctcctagttcttcgttgactagctctatggccggtaaattggccggcgtaatcgttaataccaaaagcggagaacctggaacagcttctgaattctttattcgtggtgtatcgacttttggtggacgagctactcccttgattttgctagacgatgtggaaattgctacaggggatttggacaatattccagccgaaaccatcgaaagtttttctatcttaaaagacgcatctgcaactgccatttatggtgctcgtggtgcgaatggtgtgatgctcatcactaccaagaaaggacaagagaattcaaaaacccgtattaacatcactttggaaaattcattcaataaaccaatgaactttccagagtttgtagatggagccacttggatggaaatgtataatgaagctgaacttactcgtaataagtcaattaggcaaggaagatatagcagacagcaaattgaaggaactcgttatgggttaaatccatatgtttatccggatgtgaattggggtgatttgatattcaaggattttgcgactaatcaacgtgcgaatatcaatatatctggtggtggtcagaaagtaacttattatatgagtttaaatgtgaaccacgatactggtttgttggactcacccaagtattattcatggaacaataatatcaataacatggggtataacttccaaaataatatctctgtgaaagtgacatctacaactacaatcgatttgaacatgaatacgcagattcgtaataatcgcggtcctaagaattcggtcgatgatttatttaaaatgatgttatcttcaaaccctataaactttccggccgtgtttcctgcacaggaaggcgatcagcatgtgaagtatggtaattccattcttacagccaattacacaagaataaacccttatgcatatatggccaccacttttaaacaagtggactcaaatatgctacatactacattgaaaattaagcagaacttggattttgttacaaaaggtttgagtgcaaacgcattggtgaactttaaaaactggtccagttctgaatataacagaacgattgaaccttattattatcgagtgaaagaaaattcttacgaccccaagaatcctgtctcatacgaattagaacgtttaggcacttcaggcaagcaatatattgctgaatccggtataaccagatctggtgatcgtactatttttatgcagttccagataaactatacacgtcaatttggcaaacataatgtaggcggtatgttgatgtatatgcagcgtgattttaagaaggatgtgcttcctaatcgtaaccaaggtttttccggtcgttttacatatgattatggtcagcgctatttactcgaattcaactttggttacaacggcacagagcgtttggcaaaaggtgaccggttcgagttttttccggctgcttctttaggctgggtagtgagcaatgaagctttctttgaacccttacgtgacaaaatcgataatttgaagttgcgtgcatcttatggattggtaggtagtgatgaaacaggcactgactttggtcattttctttatttggataaagtggaactagacaacatcaaatatagtaccggttatgattggcaaactacatttggtggcccgaaaatttcaagctattatgtattggatgctggctgggaacgttctaagaagttggatgtcggtttagaaatgacacttttccgtcattggaatattacggcagattatttctacgaaaaacgttcgaacattctgatgcaaagaaaaacatggccaagtcaattgggatatagtgccacaccttggagtaatgtcgggaaggtagacaactggggctgggagttcagtaccaactatcatcattccattaacaaggacttgtctatggactttcgtggtaactttacgtatgtggagaacaaatatgtgtatagagatgaaccctatacaccgtacccatggaaaagagaaaccggacgtcctttgaactcgacatggggttacatagcagaaggattatatcagaccgaagatgaaataaaatacggtcctaaggtagaactaggaagtaccgctcaagtgggagatatcaaataccgtgatttaaatggtgatggtgtaatcaatgcagatgatcagggaatgatttcagaatatggtggaaatccacgtatacaatacggatttggtttgaatataaactataagaaatttgatcttggagtgttctttaacggttcggctatgcgcaagattatgttaacaggtattcatccgttcggagagtctgattacaacattttcaaatttgtagcgaaggactattggacagaagctaaccctaaccctaatgcagcatatccgcgtcttggactacaaaaagcaaactcagacaataacgttgtaccgagtacattctggatgcgtaatggtaattttttacgtttcaagacgttggaaatcggatatcgtttctgcagatacggtagaatctatgtgaccggggataatctggctgttttcagtccattcaaagaatgggatccagagttggagtggtataaatatccgttgcaacgtacattcaatataggattgcaattaaatttctaaacctttaaaaattgtcatatatgaaactattaaatacaattagaatactaagtggggcattgttcatctcgctatgctgcttaacagcctcctgtaatttccttgagattgttccggtagaacaagctgatttggatgacgcaacacaagatttcaacagcactttggggttcttgcattcttgttatgcaggaatacaatcgcctgtagcttttgaaaatacagaagcctctgcagacgaatatgctgttccgcttgagtatagtttgcaaggttataattcactcaaagtagctcataatctatttacaggtaataataatgatggtggtaaatggagtaactattacagatatatcgggcaaattcatctgttcctacaggaactgaaaaaggcaccggtaagtgatttgataaaagaggagtgggaagcagaggcttatttcctgatggcctattaccattttgaggtgctgcgttgttatggaccttgtcccatcagcgacagattacttccacagaccgctagtgaaaatgaatatccgggtcgtatgcactatgattatgtgacggattggattgttcggctattggatgaaaaggtacttgcaggtgataagttgaggaatactcgttcgaacacagaagtgggtagagctactcgccctatcgctcttgcactgaaagcaaaagtattactttatgcagcttctcctttatggaatggaaagttcccctacccagagtggaaaaacgtaaagttaggaaaggccatggaaactccgggatacggtacagcgttggtgagtactacatacgatcgtgagaaatgggtacgcgcagaggaagctgctcaagaagcattgaatgcagctttggatgcaggacactatttatttggcacaagagctggcgatgaaagtttgcaggagcagaaaggacttccgatgccctatattcctaatatagaggggaccgatactgaagttaaggcatttcagaataaagtattgactttgcgttatatgatgacagccaaaggcagtgatggcaatctggaaattctgtgggagttacacaaaactaccaactttgtcttcggaagtataccaaacaacataatgaaacttaacaatggttctgaatatggaggttggagctcaacttctccttatttatatgctgtagaacatttctataccaataaagggaccttgcccaaaatcgctgcatcaaagaatgaatatcctgctgaaagtaaatggttggacccggcgggtgttactggccgttcggaactctttaatatttgtgtagctcgtgaacctcgattttatgcatggttgggattccatcaaggcgattattcttctcgtctagccaatggacaaccgattcaaatagatacgagagatcctgataaacaaggatataatccggcaaagtataaccgtaatcacttggtgaccggctttgctatccagaagttcctggatcctaacacgcaactggacttatccggtggtggaggaattccgaatcctgcctatccattgattcgtatggcagatctttatctgatgttagcagaatgtcaggccaatttgtcttcggatggtaaatcggatacttacgcgactgaagcgcttaagaatcttaatgcggtgcaccaacgtgccggtttgaaggccattactaaagaggatttaacagatatgccattgatggaatggattaagaacgaacgttatgtagagttctatgcagaaggacagcgctactttgacgtacgacgttgggtagaaggaggtaaatatttggctgctggaaagcgtgaaggattgagagctgaagaaaaaggattggagtatgacgaattcaggcaacgtattaaggtgaatcaaccttatgaatggaataatagacagtatatacttccaatttactatgttgatgtgaattctaatccgcaattggttcaagctcccggttatggcaattaattaattaaaaagatatacagtatgaaaaatatatatattttatttcttctcggagtagtggtgaccactctctcttgtgaagatggtaataaaaactatacggaggaatttgactctgtctactattatctgaaagagggggttaatgaatttgacttctatagtgtgaatagtgccaaagttcagaccatcactgttggaagaggaggacatgggttgaatggagtcagcactatcaatttggttccttttactcaggctgaaatggacgagtataatgcaactatagatggcgattataaacttttagctccggaatactatgatatgcctgctacagtagcctttgaggatggtgtcgaatatagaaatgtagatgtggtattcaaaggaaatatgagtgaactggctaagaccggcgagtatatgctccccattcgtttagaagctgataatggaacggtgaatgataacaaaaatatcatttatttcaagccgaacatcatcgtacctagcatcattacggatcctacgggggttcatgtaatcagaatggaagagggtaagagagagaaacaaagttttgagcttgctttctatttagacgtgaaaaatgagtgggatctcaaattgagaatagagaacaacgaagatgagttggaaaaagctgtaaggcaatataatgaaacgatgggagttgattatcttcttttacctaaggaaaatcgttcgtttgaatcaacaatactttttcctgcaggcgaggcacttgcttcctcttttgtggaggtgaataataataatctcatgatggatgattacctgcttccaattattccgaaaaaggtggtgggtatgccgtttgatgtaagagaagcaatctgttacattcatgtgatggttaccggtgaattgaaattaatttctttggctgatgatatgttgagttccaatagtatacatcctggtcaaccactcagaaatatgcttgataatgatattaaaacatattatgaatctatttggacaagcaatacagaccctaagcatgattcgaaatatggtgtgtatatagatattgacgtatctgatgttactcctatgatagagaagcaaattaagattgattattcgactagagagtatgcaaatgctgtacctaatcagattattctttatgtaggaacgagtgtggataatttgagaaaagtgggtgagttgagtgcaacgaaaaataatttgcctaaaaaaggtggagtttggacagatgactctgaacaaaatgtagatatgcctcaattctcggtaggacgtcaagagatatctttaattcgtgtctctttcttgtctagtgctaatggtacacaaattaaaaacctgacacaatccggagccataagtggagaccaaaactcggtcgcaatatcaggatttagattgtatggtaaataattgtgaaggaataaaaacgaaaatatatggaagctttaatgaaaaatatatggagaatcattcccgtgctactattatctgtagcaatggcaggttgtagtgacgatgatgatacaacttcgtcattcttcgaactttcttcaacggatttggaatgtaacagtaataatgttatcgatgttgtagtacctatagagggccagacatataagttgactgtaaaatcttctgtggatgtaatttggacaactaagcttgaaggtggcagttggatagtagccacacctgtgactaagcaaagtggggacggagagattttgattgttgcatcgagcaacccgactaatataaaaaacagagtagctacagtgactattagaaacagtgttaacgacgagatttatagatatgcgtttacacagtcgtatgatccgaatcaaatggcgcaaaaagaagaattatatgcttacattcattataatgaggacagatataacaaagaagaacttatttatactacttctataaataaggtagagggtaatgtttcaatttcttcacttggccaagaagaactggataaatataatgaggataatctcactctgtataaacttctccctactgattgctatactttgccaaattcgataagttttgatggagaggtatctgccttattggatattaaattcaataagaaaacaggagatttgagtacaagtgaagagtatatgttgcccataatagtttctgtagatgatagaaaggctgaattgatttggttggtagtgaacatatacgatcggaatatctcaaggagcgtgaaacaatttgatttttataatgccaatcaggatatcactaccttattgacaattaataaagaagagggtgaagtgactctttctgcattcacagaagaggaactgaacgcacataactctttgtatggtacaagctacatgtctattcctgaagattatattgtaatgcctgcttctgttgattttgatgattcggatctgtcgaaagatgtaaaaataacatttaaaaaagaagtaggagagttggatgaggataaagaatatgtttggggtattcgtgtttatgtagatggtttccctgtctctgaaatctttatgaaacctcgtattgcaactcctgttgttactatggagtcgaaagagtacaagcatattcttattttggaccaaggagagaaaaaggcatcttacggttttaatctttctcttgatgtaatcaatcagtgggaatttacggtggaatttgaagagaacgaaactgctttgaaagctgcggttgataaatataatgcggataaaggtacttcctatacattattacccaaaggcaactgcgttttatcatcttccgaatttacacaggaagataatgagaaattagtgactgctacattgtcaggggatggtttgactttagataaggattatttgtatccgattattccaattggatgtggtaatagtcctttcgaagtcaaagaaaagataacctatgttcacgtgattatggaaacaaaagtggagtcgatcagtgacttgagaagtataaatctagaagcgaatatgctaaaggcaagtgctactgacggaggcaataatgtaggtaatctacttgcatataataattattggcaatccatttggtcacctaacggaggtaaaaacgatcctaaaatagatccggtatatggcgtgtatctcgatattgatttctcaaataaacctctttcccaagcattctcattcaactatttgccgaggaattggcctaatgctgttcctaatgaaattgttgtttatgctggaacaagtaatgatgatttgaagaagattggagaattgaaatatgaggataaccaactgccgtttgcagacaaaacttggattggtcgtgtcagcgaagaagatttgtccaaattgtcactttacagtttgaaagagagtggagcgactttggtacgattgtcattcatatctagtcgtgataagacttatagtaacaatagtgtaaagaatatattgggttatgattatacgaagtggaataatagtggtgattacccgtgcgttgcccttcaacagttgaagatatatggtaagtgataaattttataagatcaaatcataaaagaaacaaatatgaatattttaaaatggatgtggaagattcttcctataatgttattagcagttaatgcaacagcttgtaacgatgatgacgatagcggaaagagagaaaggccacttacttttgaagtgaccttcttgagcttggtttgcaattatacccgaccggttgttgtaaatgctccttttactggtaaagattatcacttgacggttacagcttcaccggaagtgacgtggaaagtggaagtggtaagtggagatttggtgactgctactccctcgggcgagcaaagtggtagtggagagattactcttacggtagctgccaatccagctaaagaccctgggaaaaaaagtgaagtcgtgataactaataacgcaaatgatgatacttataggtttgtatttacacaagtagaaaaggtgttacttattccggaacatactatgatcggacaaagcggacctgaactttttgaaaacgaaaacagcaaatttaataagcactacatgaaagaaagcgacaatgtggctctcttttgggaaaaatcatttggtaccaatccacaaaatgcagagcggaagttcaatccggatgatttgctgaaaatggcggaggaagtatatgacttcatgaaatatgatttgtactttggaaataaggaagaatccgtgacgaataaatacaagctcattgtgtatgtgataaatgatagtgagggtggtgctacaggaggaggaaattatccggtaggtgagttggctattcgtccacatcattcgggaaatcctaatatggtatatcatgaggtgtctcacagtttccaatatttggccttgtgggattcaggtattaaagatgcttggttccctggcccgatatttgaaatgacttcgcaatggacattgcttagacgttctccggaatggattgatcaggaatttaatcattttacgaattatattagtggcacgcatcgatcattggggcataatgacaatgcatacaataacccgtatatgtttgagtattgggcgaataagcatggagtggaaatcatgagcagaatatttcaggagactactttggacgataagacagaatcgggccaactcaactttattaaaacctataaacgtttgactcacattaatcaagaacaactcaatgaagaaatgtatgatgctgcatcccgtttcattacctgggatttgccgcgtattgaaatggcatatgctgccagaggagctaatgtgcatacttgtcagcttgttcaattgggagtgacttatcggatctcacccgaacgttgcccaagcaactatggatataacggtattaaattaacagtaccggaggccggaactacagtaaaagttaattttagaggtataataaacagttcagagtataatattcacaaaccgaataatgctcaatggagatatggatttctggctgtgctgaaagatggttcacgtgtatatggcgagccaagcaaagaagatataggatctgcaagtcttcaggttcccgagaatacggaacatctttggctggtagtggctgctactcccaaagaaatctatgatacgggggctgacaatcagtggccttatcagtttacattggataacacagaaccagatggtgacaaatgtagagtaattaagaagtaaggtctcaataaacgaatgattatttctgagaaagttaccttaagtagctctttaaagataatcattcgtttttgttaatggatattgctattcgaaaccgtaatttaagtcttggtaaatatgaaacatcgtttatgggcatttgttgttgcttttttgtgttatagttcgatagtctttgctgaaagacaggatatcctgctaaataatcagtggaaattccgtttttctcatcaagtacaaaaaggtacggaagttcgagtggatctacctcatacttggaatgcgcaggatgccttatctggtaaaatagattataagcgaggaattggcaattatgagaagaagctatttgtccagtcacaatggaaagggaaacgtctctttttacgttttgaaggagtgaatagtatagctaatgtgtttattaaccgtaaacatattggtgaacatagaggaggatatggagcttttgtgtttgaaatcacagatagagtagagtatggaaaggacaattctattttagtacgagtgaataatggtgaacagttggatataatgcctttggtcggagacttcaatttttatggaggaatttatcgggatgtgcatttattagttaccgatgagatttgtatttctcctttggattatgcttctccgggcgttcgactgattcaagatagcgtaagtcatgaatatgcttgtgtacgtgctcttattgatttgtctaacggaagtgacaaattacgggaactggaacttaacattattctctcgaatgcaggtaaagtagtgaaagaaaaaaacgaaaaggttacactttatcctgattctgtttcacaaaaagaaatgaggatagagttgaataatccacatttatggaatggacgacaagatccgtttctgtatcaggtagaagtctctcttttgcataacggagagatactagatcaggtaatacagcctttgggacttcgtttttatcgaatagatccggatgagggttttttcttgaatggagaacatttgccacttcgaggagtatgccgtcatcaagataggagcgagataggtaatgctttgcatcccgagcatcacgaagaggatgcggcattgatgctggaaatgggagtgaatgccgtgcgactggctcattatcctcaagctacttatttttatgacctcatggataagcttggtatagtggtatgggctgaaatcccttttatcggtcctggcgggtatgaagataagggtttcgttgattcaccgtctttccgtaccaatggaaaagaacagcttaaagaattaattcgtcagcattataatcatccttctatttgtgtttggggattgtttaatgagttggcagaatatggagataatccggtggagtacattaatgagttgaatgtactggcacatcaggaagatactactcgccccaccacttctgccagtaaccaatcaggaaaaataaactttgtgaccgatcttattgcctggaaccgctatgatggatggtatggtggtaccccacaagatttaggaaaatggctggactggatgcataaagaatatcctgaaattcgtattgctattagtgaatatggtgccggcgcaagtatatatcatcaacaagattcgctagtgaaaacaaatcccacaagttggtggcatccggaaaattggcaaacttattatcatatagaaaactggaaagcgataaccgaacgtcctttcgtttggggaagttttgtgtggaatatgtttgactttggtgctgcgcaccgcaccgagggtgatcgtcctggagttaatgacaaagggttggttacatttgatcggaaagtgcgaaaagatgctttttatttttataaagcgaattggaataaagaggatcctatgatttatttaataggtaaacgtaacataatacgtgtgcagcgacaacaaacgattatagccttttccaatcaacctgaagcagaattatttgtcaacggaaagagttgtggtaaagtggaaacagaccggtattctatcttggagtggaaacatgtgatattgacccctggaaagaataaaatagaagtgaaaactacaaataagaaacagacactgacagatatgtattattgcattttatgaaaagtatatattatactgggttgaatacatctaatggtcaggaaaaggtaatacttaatatcaatataataaaaacaaatctatgattataaatatgaagcagagcttaatagccgctattggtttgttattatcaagttctttatttgctaaagattatttgatttcgacgtccaaaacgtcattgttgattacagcaaatgcaggtgaaccatcaaagatgcaatattatggagtcagtattgctcccgggcagatacaaagtatctatgatgccggactggtattgaatgcgaacagctatcccgctttcggtctccagacggtaggggagaaagcgattgctattactcaaccggatggcaatatgtcacttgacttggcggtagatgcggttactcaatacacttccaaggatggagagataaccgaagttcttttgaaagataagatatatcctgtttgggtgaaacaatgttataaggcttataaaggaacggatataattaccacttgggttgagattggcaatgcaggtaagaaaccagtaacactgtttcagtttgcttccgcttatttgccgatgtttcgcggggacaactggctgactcattttcatggagcctggggtgcggaacatacgatggatgaagagaaactgacgaacgggcaaaaagtgattgctaacaaagacggactggcgaatacggaaacggataatccttcttttatgttgtcgttggacggcaaaccgcaggaagaaacaggaaaagtctttgggggcgttttggcttggagtggtaattataagttgaagctggatgttcgcaacacagcactgaatataatagccggtatgaatgaggaaagttcacaatacatactggaaccgaaagagacattcgtcactcctgaatttgccatgacatatagtaccaatggcaaaggtggggtgagtcgtgcttttcatcattgggcacgccaatataaaatgaatcggggtgaaaggctgcatgacatcttgttgaatagctgggaaggtgtttatttcaaggtgaaccaaaaagggatggatgagatgatggaagctttctctgccatgggtggagagttgtttgtcatggacgatggctggtttggaaataaatatccccgtaatggtggaaacagtagtttgggtgattgggaagtctgcaaagaaaaactgcctgaaggtattgaaggactgcttgcgtctgccaggaagcatcatataaaattcggtatctggattgaaccggaaatgtcgaatactaagagcgaactgttcgaaaagcacccggactggattctgaaaattgataaccgtcctttatctaccgggcgtggcaaaacgcaggtagttctggatttgactaatccgaaagtacaggattttgtttttggagtggtcgataatttgatggcgaactatccggaaatttcctatatgaaatgggatgataattgcagtttgctggattatggttcttcctacttaccaaaaaacaagcaatcacatctctatattgagtataataggggtttacagaaagtacttcagcgtattcgtgccaagtatcctgaactcgtgatgcagctatgtgctggtggcggtgcccgcgtcaattatggattgcttccatattttgatgagttctggacgagtgatgatacggatgctttgcaaagaatttatatgcaatggggagtttccggtttctttccggctattgctatggcatctcacgtaagtgcggacaagaatcatcagaccggacgtcgtattccattgaaattccgttttgatgtggcaatgtccgggcgattgggaatggaaattcagccgaaggacatgaatgatgttgataaggcattcgccaagcgtgctattgcagcgtataaagatattcgtcctgtggttcagttcggtgatttgtatcggttggtgtctccatacgataataaaggagtatcctctctgatgtatgtcacttccgaaaagaataaggcggtcttttatgcatataagatttctcatttcatcaatatggttattccgaaggtttgtatgaatggattggatccgtcgaagaattatcgtttggtagatttgacacctgtggacagtagcaaaccttgtgacctgaatggtaaaatcattagtggaaagatattgatggaagaaggcattgcattaaaatcattgctgaaaagtgaatattcaagtttggctttacaactacaggctgtggattaagttgataaaagacaatgagaatgataaaaagagaaattcctgttattggtatttctactgaaattgatattccgggaagaatatctgtgaaaagaaaatatgtggatgctgtccttcaagcgggcggcatcccttttattcttccgtttaccgacaatgtacagattttacaatctgtggtttcttttattgatggtttactcctgacaggtgggggagatatatcgcctgtgatatacggagaatcgactcttcctgaatgtggagaatgttgccgggatagggatgactttgattatgctttgctgcgcttagcatccgaaaggcaaattcccgttttaggtatttgtcggggaatgcagattattaatacttattttggtggaacattatatcaggatttgcctgctcaatatccctcggaaattaatcatcggtcaccggatgcgtttatgatattacagcataatgtgcgatgtttgaggaccggaaaattgtattctgttacaggcaaggaaagtttgaaagtctcctccattcatcatcaagccgttaagaaattggcttgtggattcaaggcatctgctttcgctgatgatggagtcatagaatcaatcgaatctgattccgaacatatttggggtgttcagttccacccagagttgcaggctgtggaaggggatgaagctatgaaaaaactatttgtgtattttatcagtcaggcaaggacattatcatgctgatagtgatataaaagagatgatacacagtatcttttacgatattattgtttttttgtacgggatttgtcattgtggtttgttctccgtcctatctttgtaaacagataaattaaggacattaaatcatatattatgaataaagttatgcgtaatcgattagctggaactcttttattattatttgtttttttgtgtacatcatgggcgcagacatcaggtttgcgcaaaatgattgatttgagcggaacgtggagttttgcattggaccctcacggcaagggagaacaggaaaaactgtggaacatggattttgcagaaactgtgactttacccggtacaacagattcgaatcgaaaaggaatagagaataccaacaagtcggagaccacttatttgtccagatattataaatatgaaggtgcggcatggtatagcaggaatatagaaataccagccgactggaaagaaaagcatatcgtgttgtttctggaacgtactcgtccgacaaccgtgtggatcgatggtcgggaagtgggtaaatgcaactatttatctaccccacaggaatttaatctcactcacttcctggctcccggttcacataagctgactattcgtgtagataacggaaaaagtattcccgggcagattcgttcaagttctcacgcttgtacggaatctacccagacaaactggaacggtattatcggacggatggaattgcaggcaatgaatccattgtttattgagtccattcaggcttttcctcaagtagaagaccgctccgtaaaagtgaaaataactctttccaattcttcaggcattggtgggaagaaactgcagttgtcagcttctgctttcaatactgccaaaaagcataaagccagatctgcagaatataatttgaaagaggggagcaaggaatatgaattcacttatcagttgggagataatgctgtattgtggagtgacctccagccggctctatatcaactgaaagcagagataaatggcatagacgagaaaacagttcgtttcggtttgcgtgactttaaaactgaagaaacgcatttcactatcaatggcgccaaaacatttcttcgaggaaaacatgatgcctgtgtattccctttgacgggccatacggcgatggacttggaacaatggcgtcgttatttcaggatttgtaaggaatatggattgaatcattgtcgttttcattcttggtgcccacctgctgcgtgttttgaagctgcggacttggagggtatttacttgcagccggaattacctatctggggagggtttaagaaagaatctgccgagctgatggattttctgatgaaagatggagagaatatcatgcgtgaatatagtaaccatgcttcttttgtactctttgccttgggaaatgagctgggaggtgacatcaatgtgatgaaagagtttgtagatcgtttccggtccatagagccgagacacctatacacgtatggttcgaatatctttttaggctcacgaggacatattccgggtgaggattttctggtaacttgtcgtgtaggcagtggtgagggttattctactcatgctcgtgcttctttctctttcgcagatgcggaagaaggtggctatcttaataatacctatcctaattcggtaatgaactttgatgaggctctggaaaaatctcctgttccggtgatcggacatgaaaccggacagtttcaaacttacccgaattatgaggagatgaagaaatatacaggagtcttagctccctggaattttgaagtgtttcgtgaccgcttggagaaagccggcatgctggagcaggcggatgatttttttaaagcatcgggtgcatggtctgtggaactttaccgggcagatattgaaatgaatctccgttccaaacggatggctggttttcagttactcgatttacaggattatccgggacaggggtcggcttatgttggtattctggatgcttttatggatagtaaaggattggttgaaccgaagaaatggagagaattctgtagtgaagtggttcctttattgacaactgccaaattctgttggacaggcggtgaatcattcgcaggtactgttgagattgccaattatggagaaacttcattgaacgaaaaaagtatttcatgggaactcaaaaatgggaagaaaagccttggcaaaggtaagatggctattccatcgggattaggattattgactgccggaactattcgtttgacattgcccgatgtggagcaagcgtataaagccgaattacttttgaaagtatccggaacttcctatcagaatagttatccgctatggatatatcctgcaaagaagcaattgaaggcaggtaatgttgtagttgcccgccaactaacggatgatgtgctgaatgccttaaagcaaggtggaaaggtattgttgatgcctcttgaggaagactgtaaagaagtaacagtgggaggattgttccagaccgactattggaattatcgtatgttcaaaagtatctgtgaccgcatcaagaaacctgcttcacctggtacattggggattctgaccaatcccgagcatccggtattcgatgatttcccgaccgaataccatacgaactggcagtggtatccaattatcaaacatagctatccgcttattctggatggtatgccaaaagaataccgccctattgtgcaggtaattgacaatgtggaacgaaatcataaactcggcttattgatggagttgaatgtagagggcagtaaattactgctttgtatgtccgacttggaagcggtacgtgacacaccggaaggattacaattctatgccgctttgctggcgtatatgaattcttcagattttaaaccgtccacttcattgtcggtagaatcgtttaagaatctgtttgagacaggtgttcggaaagagggaataaaagtgctggataatatctcttacgaataagtgaagagtaaggagaaaatcgtatcaataaaggcaaaaaaatgacagaagtgcttgaatgctatacggaaagaaatagaaaaaaagcagactttacgatattattgtccttttgtacgcaattcgccaatgtgaatctgaccagcggctatctttgcgatagaaagtaaaacgtatggaggatattaacatttaaatcaatacagataaactcttataataaaatgatgaaaagactaattacatattcgtgtatggcgattttcgctatgggaagcatggcgcagaatcaaaaggatgaggctcaaatgaatcgtttcatatccggtctgatgaaaaagatgacactggaagaaaaagtggggcagttaagccaatgttccggtggatttgccacaggtcctgataatacacgtatcagtcggacagaagatataagtaagggattgatcggttctttgctgaatgtatccggtgctgccaatactcgtaaatatcaggaggcagctatgaaatcacgtttacagattcctttgcttttcggattggatgttattcatggatatagaacaggttttccgttgccattggcagaggctgcgagttttgatctggatgctatagaaagaggatcgagatgtgcggcaaaggaagctgcagcagccgggttgcattggacgtttgctccaatggtggatattagctgggatgcccggtgggggcgtgtgatggaaggggccggtgaagatccttattatggctcgttggttgctaaggcgcgtgtacatggtttacagggagatgatttatcgaaagagaatactattttatcctgtattaagcactttgccggatatggtgcagctattgccggaaaagattataatagtgtggatatgtcgatgggacagtttgtcaatttctatatgcctccttacaaggctggtgcagaggccggtgctgctactttcatgagtgcgttcaatgactttaataacgaaccgtctaccggaagtacttttctgttgagggagctcctgaagaatcaatggggatttaaaggatttgtggtatccgactggggatcagtgggagaaatgatgaaccaccgttatgcgaaagatgaaaaagaagctgcttataaaggaatcaaggccggactggatatggagatggtaagtgaatgctattccaagaatctggtgtctctggtaaaagagggtaaggtatctatcaagctggtggatgatgctgtcagacgtattttggaacagaaatataaactgggattatttgatgatccgttcagatactgtgatgaagaaagggaacgtacagtgattggttcacaggaatcccgcaaggaagcatgctacgtttccgaacgttctattgttcttttgaaaaatgaaaactcggtgttaccgctttcttcttctatcaagaaagttgctttgattggtgcactttccaaatcgcagaaagatatgtgcggtgcatggtcctgtgcagaggttggtaaagtagtaaccttgtatgaggcaatggagaaacgaggagtggacatcaactataacgatggctacgacttgaaaacgaataaaattgtaaatctggatcagactttagctgctgcccgccaatcggatgtggttatcgttgcaatgggagaacaagcttgggaaagcggtgagatgcgttcgaaaggagatatttctattgctgccgaacaacagcgtttggtttccgaattggtgaagactggcaaaccggtagttgtactaatgatgtgtggtcgtcctgttattttcaatgaagttcgtcgggaggctcccgctatcttatgtacctggtggctggggagtgaagcgggtaatgctatctgtaatgtactttggggagattataatccttcgggtaagctgccaatgacttttccgcagcataacggacagataccattgtattatcaatataagagcacaggacgccccactgcattgggcggatggtgtgcgaagtacattgatattcctacggagcctgcttatccgttcggctacggtttgtcatacactactttcaattattcggatgtgaaactgcttccgggtgatggaaaaggtacttatacacgtgttgctgtaacggttaccaatactggaaaatgcgagggcgaggaagttgttcagttgtatgtgcgtgatgaggtggcttctatcactcgccctatcaaagaattgaaaggctttgaaaagattaagctgagtccaggtgaaagcaaaacggtcaccttcgacgtaaaagatgaacaactaggattctacaataatcaaatgaagttcattgtggagaaaggagacttcactttgatggtcggtggaaatagtcgtgatttacaagaaataaaatacattcttaactaagaactaatatgaaaaacaactggaaaagatggctcatatttcccgctctattgcctttcttctcttggatggaggcaaagacattggaggaaaatcagattcaacaatctttggacaccattgaataccgggtatttgtggctgtcgataaggccggagtggagcattggggaggtaaagaagcttatcaagcgaagctgaatgcttttttcgaccaagtgaacgacttctggaacaaagccggcaatggacgtttcaactactatttccgttatataccggatctgcaggtgatttacgactgctcctcccgccaattggagaaaatctatcagaagagtgccggttttcccaatcacgatgtactgctgattatagattctattcttgattttgacgatgaagaatcggctaaaggatggtattgcggcggtggggcggacgatctgaatatggtaatttgccgtagccgtagcaagacggaacatgaagatctgtttggtatcgactattttcatagaggagtggcacatgagttcggacattatcgtggggtaaccgacttgtatgctgatagaatccgggcaaagaacaatccggtgaaccatatcgaatatgaacctgactcttgtgtgatgaacagtcattataaaacatataaatggagctcgtatgcagttcatataatcaatcacaccgccaaatccaaacgtccgagacgtgatttcgacggattcttcaaacaaatgttccccgaaaacatacaggtatctgtaaaagtgaaaggtaaaaagcaaaaaggggtaaagctgaatctgtatggttcacgtgcaaaattcaatgacctgatcgctactccttaccgtacttatgagacggataagaaaggagaatatctgataactggtgtccccaacttatatgatagccccgcacctcctttgcataccgacgaattgccttataaccgctggttcactttcttgctcgaagccgaatataaaggggaaaaaaaatacgtatggcttcccgaatatgaggtgcaacagaccttctttgagaataaggatacctatcaggtgacaattgatttctaaaaaatggtagcgcgaatgagataagaaaggtgctatttagcacttgttcaatgctttattagcaggaaattcttcctgttaagcttcctcctttatctctgccaagcggtactcttatgataaatatgtaaataaaaaactgtgtgaaatacaaaaagtattagtttatgaaacgtatgatgaaaagacttttgccggttctaatggctatcgcacctttaaccatttgtgcacagaaagtgtacgagctgaaagacatttccggtaaagtgcaggtgaatgtgattgtgaatgataagaatgtggaatactccgttcttcacgacaacgatgtgatggtggctccatctcctattttcatgaaactaactgatggtacagctttcggactcaatccgaaagtaaagaagatcagccgccgttctgtaaatgagactatctatcctcccatctataagaagaaatcaatcaaggaccagttcaatgaactaaccattgactttaaaggaggatatagcttggtgttcagagcttatgaagatggtgcagcctatcgttttgtctctgaactgaagaagccgtttatggtggaaagcgagcaggcttctttctgttttccgaatgatccgaaagtttttgtagcttcaccgaaaggccgaatgaacgagggcaagaaagatcctttctacagttctttccaaaatacgtatctggaaactgccttgtctgcatgggataaggaacagattgcctttttaccggttttggtcgagggaaagaacggaaaaaaaatctgtatcactgaagccgatttgatgaactatccgggtatgtatgtgaaacatggtgagcatggatattctctggatggaatctttgcagcttatccgaaaacgatagtagacgaagttcgcggactgaaaggggtagtaaaatctcgtgaaccttatattgctagagtggagggaaacacagcatttccctggcgtgtcatggtcattgccaaggatgatgcagaactgctttgtaatgatatggtatataaactggctactccggcacaatttacagatttttcttggattaaaccgggtaaagtggcttgggactggtggaacgactggaatctctacaacgtggatttccgcgcaggtatcaacaatgagacttataaatactatattgactttgcctcgaaattcggtatcgaatatgtgatattggatgagggatgggcagtgccgggtaaagcggatttgtttgaggtgattcctgaaattgatttgaaagagttgattagctatgcaaaaagcaaaaatgtagatttgatactttgggcgggctatcgtgcttttgaaaaagacatggatcgtgtatgtaagcattatgccgcaatgggaatcaaaggtttcaagattgattttatggaccgtgacgaccaacaagtagttgagtttaaccgtaaagcggctgaaaccggagcaaaatacaaattgctgatagatctccatggaacgttcaaaccgactggtttgcaacgtacttatccgaatacgatcaatttcgagggtgtccatggactggaagaaatgaagtgggcagaaccgggaacagatcaagtgatatatgatgtgacagctcctttcatccgcatggttgccggaccacttgattatacacagggagcgatgaataacgtaatcatgaagaactttcatgctgtctatacagaaccgatgagtcagggtacacgttgccgtcagttagcattgtatactatttttgattctcctattaatatgctgtgtgatgcacctactaattatctgaaagaggaagaatgtacgaagtttatcgctgccattcctactgtatggaatcagacacttccaataagcggaaaagtaggcgaacatattgtaatggcacgtgagaaagacggtatctggtatgtgggtggattgaccgactggaaagagcgtgatgttgaagtcgatctgtctttcttgggtgatggtgagttcaatgcagaaatatttagagatggtatcaatgccgatcgtgttgggaaagactataagcgtgaagtgatccgcgtatcagccaataagaagttgaatttacacatggctcctggtggtgggtttgttgtgaggataacaaaataataattgaagattaagtttttggtttgaaagaggacatcatccctatgggagatgccctcttttttatgagatgagtgtctcgtgttataactgttactgtgatttattgataaactttagaaccggaaactcaatcctcctaagaaattgaatccttccgtaggataacctaaataatattgatatttcttgttcagcaggttatgtacttgagcataaacggatactcctttgaatacattatagctggctccgatatgcaaatcattaattgcggtcatttttgcatattctttcacttctttccggctgatgtaatcataacctagatttatgttaagagcagagatcggatgaatacgtacattgaaagacatttcactgactggtttcacagccaacagatattcctctgttttgctgtcccaattacggtaagtatatttagctgatattccgaggatatctttgtaatcgtaactgatttcaccgccaaggtagagattttctgtattatcttgagcaaaagaaaggtaagaacctgaatgaatattacttgggtcaaaacctaaataagataagtcgttctttagattctgataaccaccgaacacgttgaaccaaagtcccggataagggcttgctttgaatccgatactaccgttgatttgctcgtaagtatcataaggacgttgtacgtatcccaaagtggcagtggtatttgcctccggcagttcaccgtaaggacagatactttctaatctgcggaaatcattcaattgcttaccgccggttgcttttgcataaacaatgtagctatcagaaaaaatatactgtgcagtgatatcgggtgagatacggaaagacttgtcaaatccgaaagataaatctacattggctccgatatgcagtttccagtcatcattatccagttcgtaatatggatttaaaagaagcgttgtgtagtttttgaagtattcatctccggtggaaacattctttgtatatccgttgtagagaagattgttcatttccaaagcgatagttattaattgttggtcgccgatagctcccgtgacatcgcctttggtgcgtatgattgtttccttgatacctgtattggcttcagattcattgaacatgttatgttgacgttcatacatcaacagatttgtttctgcgttgaaacgcagtggggcagtctcatcagtgaaatgaatgcccgcatggaagtcaccggatgtgaatttctgcttgctgtttacgctttccggttggaagttgaagttgctcaatccgaagtttccggcaatatttaagtccagtttattaaattggtgtgtgtaatctacatttgcgcgtgtgcgataataaaatgcattccatttttcggagtctgtgaaaggaagcgttagtttaccatccattccatccatttggaaacgtacattcaatttgtctttctgcgacagacggaatagataattggcaagaatatccaaattgccataattaccatatccggcacgtacatatcccggggtagtgccgggttgaacttcttttccggtataggggcgcatcaggcctgccggaacggaagtggccggaaagaatgttgtagcatattctacttctttcttgctcactgtcggttcttctactttaggcaggacgttcactttcgaagcatccataatgtccgggttatattcttgttccacaacgaccgtgcgggtcattgttgtatccttcggttgggtggtttgggcttgaaggcaggatggcattgagattgccaatgcgagtcctcttattatataatgagatcgtttcatacttttctatttttttattctcaattctcaactttcaatttactaagtctgctttcaatcatgctttcaatatcgtcattcccttgataattttgttgcagacttagcagatattggcgtgcgtccagatctttacccgtagcatgatagacgtcggatagaaggataaaactgcgcgctagccaataagcatgtggcgtactctgttctatatagttgagcaactctttctctgcagcggcatattcttttgcgtcgtagagggattgtgcaacctgatatttagcttcggcaccgtaagagttacgtgtgtctttggccagttcacgatagtcttccattgctttcttgtcagccttttgcttggtataggctttagcacggtaataaagagcttcatttcttagctccggactaagtttggcctctgcaagcaagtcggtagctgcatggatggtttctatgtcatctcgcaataggaaggcgcaacgcagaatacccgtttcagcaagttggcggcgctctacgttggttgctttttctttcagcattttgtagctagccaatgcttcagccatattttgctggttgaattgcacttcagcacgcaagatcagtgcttcttctgcaaacggattgtttggatattccaacaacttaccggaatggagaagaatcatatcataattcttctgctcgtttccgatcaggcagagataataatgtgcgttcaggctgaaggctccttccgggaaagtttgcaggtatttgttgaggcttgttttggcttcttccattctgcctcgtgcataaatcttttctgcggcggcatacgtaagcgagtcttgttcgttagcatcgaaacggatgtgtcccggcatggcatttgctaaagcagcaaattcgtcgatacggttgaggtctacataaatagatttcaaatcacgcatggcaaggcgtgcttcttcactacccggatatttttcaataacctgtttgtaggcttcgattgcttggttgtaatctcctttttggtaatataataatccgatttcggcggcagctttccggctgaccgggctttcaggatatttagtaagcaattctttgaaagaggtaatggcttgattgttgttgtccatcaaaacataggaacgtcctttctcgtaaatagcgtttacggcataaggagaagcagggtactttcctaccagacggttcagcaaggtaatcttaccggtatagtctttctgcagaccggatacaagagccagctgatagaaagaatagtctccggaagaagtattcatctgctcggcttgcgaataatactgtttggcttcttcaaagttacgtacatgcaggtggcagtcaccaatacgattgtatgcatcggcaagtgtggttgcattttcacctttctccagttgaacgtatttttggaaataattgcttgcttgcgtatagtctttccggtggaaagcgatataccctaagttataattggcaagcgcatacatttcgttattgggttgggtggtgagttgcagataagcattaaaatcacgtgcggcttctaccattcggtttagacggtaataggattctccacaccaatagtaagcgtctgccttggtctgacgattatattgtccgatggcaatggattggttcagatatttcagagcttgttcgaagtcggcgttagcgaaagattgagttcctaattggaacagtatcttttgtttggcttccaatatttgcgcgcttggtttggcaatccggtcgattgatttcaaagctgcatcgtagctacgtgtattcatgtaaacttctaccaggtagctgctgactttttcagcataaggagaagtcggaaattcattcaggaatttctcgaaggcagtaactgattcaccgaaagcggagaaagaagtctcgtgcaggcaaagagcgtaattgtaagctgcctgttccttgatttgcatattagcattggaggcggctgcctgttcaaaagccatgcgtgctttgtttttctctgccagttgcagataagagagtcccatgtggagatatgcattttgggtaagggcatcgttgtcagttgtcaccttacctaatgtttcggctgctttggagtatacttttgtttggtagtaggagagtcccagcatataaagggcatcccggcggggagccgagcgatccttattcaagtaattgttgaatgcttctacggcttggtgatattgtccgaaatggtaataggcatctcccagaatacggtacatttctgctgcgtgctcgttattcgggtaggctgacaggtagttttgtgctacaatttgtgccttatcatagtttttgagctgcgtataaatttcggctatataataagggacgagtgctttgtattttgagtcgtcctgtaaggggaggaagcctttcaacgcttcagtataacgtttttgtgtatagcggatgtaggaaagatagtaatcacaatctttggcgtatttggggctgttggcacgcaaagtttcaaaccagatggctgcttctcgtaggttatcggttttcagataacaggtagccagttggtaggtgcagtcgtcccgttcttcattacctaacaaatcgaggtcggcagagttgaagagtgccagtgcttcatcatattttccttcgtagaaatagcaggaggctaacagcgcataaatgcggttagcgtatggagtatcaggataacggtcgagatatttgcggaggagttcgatgcggtttttgtctttcagttcgtaagccgaactgactagcatatactctgcgtcctgaagaaggctggctgcaggcttttgttttacaaatgctttcaatgccggcagagcagctgcataattcttttcctggaaaagttctttcccttctttataaaggttgtcagtcgaagtgaacttatcacctgtctgggcaaatcctataatgggcgtgcagcagatggcggcacaaatgagtctagtaatttcttttttcataatcgggtgtttatgcaaaagtactacatatctttcaatgagaatcctttgaaagttattttataatcatttaattctttatgtaaagtttctcctttcttttccaatgccgggatacttatttttctcggatttctttttacttctccgataagtgctgttttgttaaaccggttgagggcgatcaggtctatttcattttctccgtttttgtcccaatagttacctacgtcggtaacttcctcttcttcagcgataagttcacggaaatatttttctaacaataggccgctgtattgttcatagttcttttctacatattctatcagtaaatggtttttccccatttctagtactgcgttgtttgagaaaataaagcgaaaccagaatcgtagaaaattgtcttgcaggcaataacgggtagcacgactattaggtttagcgaacatcggtttcacttttttgattaatgaatattcatcctcaaggttggctaaataggaaccggtgtttttattgatgatggaatcaatctctcgttgtgttgtttttccttctgcaatgagagataggatagaaaaataattggcatagtctttcccgaactcggaaattaacatgtctttgccttctgtcagaaatggtgagccttcggaaagcgcataatttatcatggcagttttattaaatgctttcgcttccatcaatagggtgatgtatttggctactccacctgtcagcaaatacaagcaaagcaaatcttccgatgtgaattggggggcatggtctgctagaatctctttgataacggtggtggtgaatggatgcagagaaattcgggcggtaaggcgtccgtatagtggctccttgcggtcttcgaatattcttttcatcattgaataaacggaaccgcatacaatgaaattgattttggaagtcgcgtgatattggtcccaaatacgttgtatgtcactgacgatagacggattgacatagagaaattcttgaaattcgtcaatgattaatgtgaaattttccttttgggaatgttgcatcagcagttcaaagagctgtgcgaactctctgatttctccatagatacgaatgccaagcgtttcctgaatgacaggttgatattgtgcgcaaagcaggacttcactctttcttgctacaaatatatatacgaatcgggtgtctttgacggactctaagagtagagctgtttttccgattcgtcggcgtccggtcattacagtaaagcaagcgctcgtttgtgattgcttttagctgcatacagtatcgccatttctttctttcggtcgtagaacttcatattattgctatcttaatggcggttaatttaatggccattaaattaatggtggttacaaagataacacaatatgttgtattttgttcatttatagtaatataatatgattgtttaagattatgtgataaattactttgatctatttggttgagatgaacttctattttacaaatacatcaattggctactgaaaaatggcccatcttaagaaaaggaatatttaaacgagaataaaaggcgtaattactgggagggattgagaagtataaaaaaacgcagagatttgtaggtgcgaaattctttctttttgttataggagatgtttgtcgattaaattgtaatgcttttcttctttttcacttgttgtgtaaactgaaatgtggttagaaactggcattttgttgtttgttgccttttcgatatttgtgatgaaatagaagaaaaacggtcttaattttcccttatttttcttcctcaccgagcaaaagctgcttcgtcggtgagaaaggaagcgttcctcggtggggaagaactccttggttttaaaccaacgaatcctttcttgatagaaaaagatgcatattcgacttgaatttatacggtattagcctgtgattttgcatacagttgcatgtttttatgcattttattctccagatcattatttttttatctgatgttttggaggaatatcttaaaaatgggacataactatagatgaaatactctcaatctatcaggctgatgagattatcttagcggcattgagctagaaacaagctaagtccgcgacggatagaatccaacccaaaatcttccggatgaatctcggagagaggtaggaagaaagaatctgctacatcatccatggcggagaaatggctcatgtcttctacagtgcagaggaaaaacatatcgagagtatgtacaaggaaacctgaataaacataaatattgggaagtgtgaactggtaaacggcttttttaactttcagccctgtttcttccagtacttcgcgggcaacaccttcttcgcctgtttcattcatatcgatgaatccgccgggaagatcgagagtccctttggctggctctttggcacgtttgcagacaagcagttcatttttctcattcaagatgagtgctactgtggcggcagaaggattgaaataatagacaaagccgcaatctgcacattttttagatttctcgttgttaatctcaaaatgagaggaaccacattcagggcaatataagaattgggcaagaggatgttccatgatcgtatatcttttccagatttttgtttatgcttgcaaaggtataaaatgcttttattaatttcatctatcaccgcatagaaatattcgattgggctttttttgcaaaggcggggtttctgcctttatctttgcatcagaaacaaaaaacaaaacgttgtttctgatgttataagtcaaatcaattaataacaataaaagcaataaagattatggaaccaattttaaattctcaacttcctgaattcagtgttcaggcttttcacaacggagctttcaagactgtaaccaacaatgacctgaaaggtaaatgggcgattcttttcttctatcctgccgactttactttcgtatgtcctactgaattggtggatatggctgaaaagtacgaccagttcaaagcgatgggtgtagaaatctattcggtaagtactgactctcatttcgtgcacaaagcctggcatgatacttctgaaagtattcgcaagattcaatatccgatgttggcagacccgactggcgctttgagccgtgcactgggtgtatatatcgaagaagagggtatggcctatcgtggtacattcgttgtcaatccggaaggaaagattaaagtggtggaactgaatgataacaatattggccgtgatgcaagtgaattgcttcgtaaagtggaagctgcacagtttgtagccagccatgacggagaagtttgcccggctaaatggaagaagggtgagtctaccctgaaaccaagcattgacctggtaggtaagatttgatagatcttgataatggtgattatgggaggccggtaacgggagacgctgccggcctttcttttaaaaaaatgaaagggaaaaagatatgttagaatctgcattaaaagaacaattaaagggtatttttgctgggctggaggcaaactttacttttgatatatccgtatcatccagccacgaaaacaaaacagaattattggagctgctgggagatgtagcggattgttccgatcatatcacttgtgtagtgaatgagggagacgcattgaagtttactttactgaagaatggcgaccgcaccggaattacattctggggtattcctaatggacatgagttcacgtcattgcttttggctgtcctgaatctggatggcaaaggaaagaactttcccgatgaggccgtttgcaaccgtgtgaaagcactgaaaggcccgatacatctgaccacttatgtttcgttgacttgtacgaactgtcctgacgtggtgcaggctctgaatgcaatgactactttgaatccggctattacgcatgaaatggtagacggtgcgctttatcaggatgaagtagatgcactgaagatacaaggagtaccctctgtctttgcagatggaaaattgcttcatgtaggccgtggtgaatttggcgaattgcttgccaagttggaagatcaatatggtattgacgaaaccaaagcgaatgcagaggtgaaagaatatgatgtgattgtagccggtggaggacctgctggagtatcggcagctatttattctgcccgtaaagggttgcgtgtagctatcgtggccgagcgtattggcggacaggtgaaagaaacggtgggtattgaaaatctaatttctgttccggaaacgacaggaaatgaacttgccgataatttgaaaactcacttgttgcgttatccggtggatttgctggagcatcgtaaagtagaaaaagtagaagtggttggaaaacaaaagcagatcactacctctgttggtgagaaattcctggctccggcactgattattgcaaccggtgcaagctggcgtaaactgaatgttccgggagaagcggagtatatcggtcgtggtgttgctttctgccctcattgtgatgggccgttttataagggaaagcatgtagcagtagtaggtggaggaaattccggcattgaggcagcgattgacttggctgctatctgctccaaagtcactgtttttgaatttatggatgagttgaaagcagacagtgtacttcaagatcgacttaaatcattgccgaacgtggaagtgtttgtaagttcacagactacggaagtgataggaaatggtgataaactgactgccctgcgcatcaaagatcgtaaaacggaagaagaacgtttggttgagttggatggtgtatttgtacagatcgggctttctgcgaatagcagtgtattccgcgacatagtggaaaccaaccgaccgggcgaaatcatgattgatgcacattgccgtacgaatgtgacgggtatctatgcagccggagatgtttctacggttccttataagcaaatcattatctctatgggcgaaggagcgaaagctgcactttctgcattcgatgaccgagtgagggggattatctgattgacatattcagatataaaaagcacataaacataacattagcaagaggaggaatgactcctctaaaaaataccctcgttacagatttgtagcgagggctatttgatatttagtcatgatatgtatatctgacgaaatcaaacaatccggaattttcctgctgtgccggttgttctccaataaatttaagattctctacactgcaaaaaatatggaatgcaatgtctttcccaaattccagttgaagttcatgtttgggctcgttgtctattaaccaggtgatgtaatagttcccgttttttaatgtcagatcaatttcgaacagatgccatccggtcttgattactacaggaacggaagaaaaaggatatgcctgcgatgtcatataagcaatcatttcgtcgggagttgcatttaactccttgcgaactgtatctttaccatatccgacttcaaaatccaattcatgttggtcgtcatggtatatccacgaacccacgctacattgatctcctattcccatttgcgggatatgagtacgccaggtatatcttcctgttgtataaatccgttctacagtgtgaacctttttccgatccaccgagttagcccgtgtaaagatccgtaagtaaccattctctaatatgcattgattatccgggttgttatcttgatgtccgtattcccatccatccagattgttgaagttccattctttgtttggcggatttttagtaacggtgtcattggtctgttgctgtgcaaagcaaaggccgcaaatgcatattagtaacagagttaaatagtagtttctcataataattgaatttaagtgtattcgttttctatcaattgcttgctgcaaaagtagtcgaatgctttattctactcatcagattttagtcatttcaaatcatgaaacgtccaaatctgcactggaaatcctaatcgctctgttccggggagtataatttctatataaatgataaactaaagtgctgaatctactctgattgttgttgggtggaaccatgttgtgctctgaattgagaaggagtcattcctttcatttctttaaataacgtactgaaatatcgttgataagtgaaacctacctgctctgatatttcagtaatgctcatgtcagactgagttaaaagaatgattgctttgtcgattcttctacgattgatataatcgtttgctcccatgccggtcagttccttgatcttattatataaggatgtccggctcatagccatttgagcagtcaggaattttacgtccagatctggttgagacagattctgatcgatcatttcattcaatttaatcataaattgttcatccgcattgctgaaagtagcctcttgcggagacagaatgaattgattgcccctgtatctggatttaatatattcacgatttctcatctggttctggatcacgctaaggagcatttccatttcaaatggtttgggcaaataggcatcggctcctaatttgtatcctaacatctggctttcagaatcggctctggcggtaagtagaataacagggatatggctaatattcagattctctttaatttccttgcatagctgatagccattcatttgtggcatcattacatcacttactataatgtccggttgctgttgcttaataacttccaacgctaccaatccattttctgcctgatagatcttcttgaacttatccttaagagcattttttaagaattctcttaagtcctgtttatcttctacaatcaacagtgaatatccttgtagagagaaagaaccggattctattttctcttcttcttccggagaacttaaaagttcgttgaggtaggaatgttgaggacatgatacttcttgttcttgtagattagccggtatttcataaaagaatgtggcccctctgtctttattattgaaagcgcccatcctgcctccatgtaagtcaatcaacattttagcataagataaaccgataccacttcctccctcattatgtttgccttggtagaaacgggtaaagagcttctttatatctacattatccaatccaattccctggtcttgtacgtgtacttgtatactttcatttgtacggatggtttttataacaatacgagtctgattaggactatatttcaaagcattcataatcagattggaaagaacaactttgcatttagtgtcatcatacgcgatagattgtatactgtcgtcaaagtcgtatgtaatttcaatttctttggctttagatgcagtttgaaatgtttctgccacttcctgtatccacttgtgtaaaggatgcgaagagatgtgtagcacttcctgtcctacctccattttgcgtgcatcaagcacaatgttgataatatctttcatctgattcgcctgtttgaatgctccctgtagatattccggtagctcgtcttgcttcacctctttatttagaattcgtttcagggaagcatagatgagtgtcaaaggggtacgtagctcatggctgatattgattaagaagcgtattttctcttcatatatcttcttctcatgttcccgcatctcacgtttcagccgattttctttttttcttatcaaactaaagaagaccactcctgccactaaaaatgcaaagaaaatgcatagtataataaaccagatagatttccaccaaggaggtgagactataatagttaagatctctatcggctggctccattcaccgttggaggtgtcgcaggatacgctgatggtatattctcctgatgctaatgtacccaattcgagtgtctggagataactctcgatcaccattttgtcttttcctgtgatgacataccggaaaaggtgttttcggaaggagttcttttcgtcagcaatcactttaatgttgaacgatgaatgattccaaggaatcgaaatacagttattattaacctgtttcagagttgatttaccattcagttttacttcaagtagcttgagaataggagacgaattactttcgaaaataatatccgtattaatgcgtaccagtcccatagtacctcccatatacagattgggagtacgaagagcaggaataggggtaaatatcaattcgttggaaggaactccatcggattcgtccaggataacaaaacgtttttcgttgataatatacgcaaagaacatgttctgcgctcctatccagacttttccttttttatcataggcaaggctggatacactgttgaacaagttggtatgtattttttctgtttttccagtctgtttattatagaagagcagtccgaaattacttcctatccagaagttacctttatcatcccggcaggccgatgtgaaatcatctccctctttcatattgactaatgaagatagttcgttagttttgaagtttagtttaaacaggttattggttcccattagatacagatgcgtatcgtcggaataaattgcctgcatagctatttggcgttgaatgtctatttggggtgcgtagagaatagatgtttgccgggtatgcttgttgtagatatagacttttgctcctaatatgtaaatattatcttttgtagcatatagatttaccaaatcaccggatgaaaattctcttttcgaaatagagtcattgataatgggaaaaggttgcatctgtgcggttctcttattaaaggtaaatacccctttattaaaacatgataataagagctcattttcagaaaaatctgtgatagaggtaactttctccccgtatgtagtagggtaatgatgaaatgtattcgttttttggtcaaatgagttgatacctcctccgtctgttccaatccaaagcaatgtatccttatcttcaaagatgctaaccacggtacgttcgctaactccattgggattgttcagtggaacatctttataggttttgatgaacactttcttaatggcgaataatcctccgtgtatactgcctatccatatattgtccatctgatctttatacagccggtagatagagttattcggcaaggattgttcatcatcggaaatatgtttaagatgagagaacttcatagtctggaagtcaagtatgttgatacctcctccgtcagtagctatccaaagttggttgtctttttcaagaaaatcaaaaatgatatcgttgttgagcccggaatttttggtggataaactgaaaagccttttcccctctttcgagtagcaggctattcctttgccatagaatgatacccaaagccggttttgagagtcaacaaatatggtgtttatctcgcgctcttttacaaatggacatcgatacattttcttttttatcaagtcgtacatccaaagcccgtcttttttactgctggttatcagcacatcgggactccactgaaagatgcggttgatacattttaacttgtctccatcaatgtcggggaagatcgtcgtaatatttttatccgtcagattgtattggtataaagtttcttctcctccaaacaggaaattgtcacctatttgaagataagaccaagcgttaaatggcttcccgttatatttcaatggctgaaattgattttctgctttattgtagatggcaattcctttattggtagaaacgtataaatcgcctaaacgatcctctgtaataaaacgaatgaaattgtcgggcaatgagttgggctgctcccggtcatgaaaataacttttcagttcagattggtcataactatttaatccccatttggtacctatccatatgactccttgatgatctctgtaaatgcactgcactcttgattgtgacaatccctgttccaaagaaatttgtctgaagtagtagtcttgttgttcagccttggtagaaagaacaaagaataatatccagattagaaaagaatacctctttagtacgtgtgcttttgacatagttatgttcttttgatagagcaaatataaaagaagttatgaaactgtacaatagatttcatcttcttttgtccacaaagctcattagatagctagaaaggatattcagaatgatccttttgaacagtagcggactaattatggatgttatttgatctctatttccatgctttgcgcctatatttgcacagttaacactaaatacgaaacgtattaaaccttaaaaaaagactatttactatggatacatcctaaaactgtagaatgaagaggcggagtaatgttgggaacattttaaatgccttgacttgtatctaaaattcctaaaaatctaatatcattatattctaactaaatgaaaagtatatggataatctaagaaaaacgcttggctgcttgctactatttctttttgcagcagttacatctacttatgcacaggttgcaaagcagtattcgggtactgttacggatgccgacagcaatgaacctgtcatcggtgtcaacgtaacccttaaagacgcacaaacaggtaccgtaacggatctttccggaaaattctcgattagtgctcctgttgggtctacactattgttttcttatatcggatacgtgactaaagaggttaaactgggaacgaataccagtttgaagattacaatgcaggaggatcagaaccaattgagtgaggtagtggtcatcggatatggtgcagtgaaaaaatcagatataaccggtgctgtggcttctgtttcttccaaacaatttaaggatcagccggtaaagcgggtggaagatattctgcaaggacgtactgcaggtgtggcagtgacgagcgtaaatggtttacctggtggtacagttaaagttcgtgttcgcggtactacttctcttaataccagcaatgaccccctgtatgtcattgatggtattatgtctggtggactggatgtaaatccagctgacattcaatctattgaagttctgaaagatgcttcggcaacagctatttatggttcacgcggcgctaatggtgtggtgttggtaactactaaaaaaggggtggaaggtaaagtgcagatttatgcagatgtggctataggcgtatcgaacatccttaaaaaatatgacttactgaatgcttatgaatatgcgactgcattgaaggagtataatggtatctcatttgcagatgatgagatggaagcctataagaatggttccaaaggcattgactggcagaatttgatgttgcagaccggtattagtcaggactataaattaggtatttcgggtggaacggctaaaaataagtatcttatttcagccaatgtattgaatatgacagccatgaccatcacgaccaagtatcaacgtgcacagttgcggataaatttggataatgaactcaccaagtggttgacactttctaccaaaattaatgcttcacgtactcacagtcacaatgggggtattgacattatgaactttctgaactattctcctacgatggaaatgaaagatccggtaacgggcgtttataatatggacccttataattcagtaaacggaaacccttatggtgcacgtgtcgcaaattatggtgactcatacgtgtatgctttgaatactaatatggatttgactttcaaaataatgaaagggttgacattgtctgtacagggtgctgctaattactctcatgttccgagttactctttcacctcgtcattagcaaaacccggacaaattagtggtatggaaaatgcgagcaggatgaatctattctggcagaataccaataatgtgacttataacacaagtttcggcgatcatcatctgactgcaacagctgtatttgaagcaagtggtgccgaaggcagaaatctaaaattgaccggaagtgatttagccaatgagtttgttggttattggaatgcaaaaaatgcaaagacacgcgatggagagaatggctattccgcagaagctattgtgtccgggcttggtcgaattatgtacaattacaaagggaagtatatgctgacaggtactttccgtgccgacggttcatctaagtttcagaagaataataagtggggatattttccgtcagcagctgttgcttgggatgttgctaaagaaaactttatgagcaaacaaaacattgtccagcaattgaaactaagagccagttttggtgttgttggtaatcaaagtatcggtgcttacacaacattaggtatgttggctcctacaaattatgacggttatggtagcgatgcaatccataccggttattggactggaaatctcgctacaccggatgtaacttgggaaagcacctatcagtataacataggtttggacgccagtgttttagacggtcgcttgagttttacagccgaatggttccgaaaggatactaaggacctgttgcttcgcaaacctgctcctcagtataacggaggtggctctttctgggtcaaccaaggtgaagttagaaactctggtgttgaattcaccattacagctactcctttgacagacaaagatatatttggttgggaaacatcgctgaatgcatcttatttaaagaataagataatcgatctggcaggtagtgattttatcgttggggagaattatacaagtattggcggtggtcccattcaaattaaaaaagtagggtatccgattggctctttctatctttatgaatgggcaaactttaatgaccagggcgccaacttgtataaacatcaatctaatggaagtttgacaaccaatccgggtgctgacgatctggttactaaagggcaggccgagcctaattggactttcggatggaataatacattcacttggaaaaactggacgctcaatctctttatcaatgctgcattaggacaagatagactgaatgtaagccgctatgcgatgggatctatgacaggtgtatatcgcttcatctctttatccgatgcttattacaaaagttgggataaagtagccaataaagcagatgctgtgtatgcaagtcataaaaattcagataatagaaactatcctgattccgatttctggcttgaagatgcatcatttgtgagactgaaaaatataagccttacgtataatattcctaagaagataacgaaagtagccgatattcaactgtcggtcagtgctcaaaacctgtttacattaacgaaatacacaggtatggacccagaagtgtacagtgaatccgattatggctttaatggtgtggatatgggatcttatcctgttccaagaacattcacttttggtatgaaacttaacttttaatcttttaactatacatggatatgaaaacaatatatagaatatgcaaatctgtcggactagcattgatagcactttggatggtgtcttgccaggatttactgacagaagatcctaaggggcagttggcggtaactaatttctttaattcaaaaggtgatctggacttggctctgaatggaatgtattccaaagttgcgagtgatatgtatgcaaatatctgggcaggtttcgaatcagtgatgggtgatgatatttctacacaccctgcagctaataaacaggggttgcgtgaggtagatacttataatgtttcggacaataacacttgggtgactgaattgtggggtgctcgttggagattggtaaaagctgctaatttcattatagataatgccggacgaactccggaggtgagccaggaagagaaagatgcagccattggacaagcttattattggcgtgcctattcttatttttactttgtaatggcttggggagaggtacctatggttgtgaaagatgaaatcaattacaacatgccattggcaaccgttcctgaaatttacgagctgattgtatctgatctgaaaaaggcagaaacaatggtccctgctaattatactaaagaaccctacgcaagaaatggggtaaacattgctgttagtcaaggagctgtaaaagcaacattggcttatgtgtatatggcaatggcgggatggccgttgaacaaaggaacagaatattatcaactggccgctgcaaaggcaaaagaagtaatcgatgctgcgaagaaaggtacttactactacaaattattacctgattataagcaagtatattcgatggagtataataagaataatcctgaagtgttgcttggcgtttactataatttgggaatagatgcacttaccaatgcccctttagctgatttcctggcagactatgcttatggtggcggtggatggggagatacgaacggagaaattaaattctggtatgatttcccggaaggctcacgcaaagatgcatcttatttcccgaaaatcatattgaagaatgaaactaagttgcgtgattggtgggaagaccccaatccggaagcgccacgtgtggttgttgctccctgtttcatgaagaaagtagaaacgaccactggagaagaattcgactatacgaatccgaagatttcgatgaatcagaatggagaaaagacgcatcagattattcgcttggcagaagtatattgctggtatgccgaagccgtaggtcgttcaaaaacaggcagtatcacggaagctgtcaacttattgaatgaggtacgcaatcgtgccaatggatctgttgttgcagaccgggatatctataagacaaccatgtcgtatgatgatctggcagaagctgcctataatgaacatggctgggaaatagccggatattattggggaaatattgccactagagcaagggatatgtttcgcatgaatcgcattaaagatcattttgaatacagaaaattaaatccggagattgaagtggctcccggagtcttcaggaaagaagctgtttccgtatctggtacgtggaatgacagtaaaatgtatcttccccgtccttttgtagattcgtctattaatccgaatttgaagaactgaatgaaacaataaaaacaatcattatgaaactaagatatttatatttagcaataggtgtattatgtaatgcctctttagtatcatgcggtgatagcttcaaagagaaaacagagattgttgcatgcggaatctccacaaatgctttaacattcggagtctcctctactgaagttcagactgtagatattacgtcagaagcagcttgggaagttgcagtggatcaggcaggtggtaattggcttactgtttctcctttggaaggaactggtaatggtacgttaacaattgctgctgataagaataacggcccaaaacgtagtgcaaccttgaccatagcggcgaaaggtgctgaacttcgaaccatcacagttattcaggatggctataaaggaaccatttataattacggtgactttactggattgcaaaagacggggcttgtggcagggatcaatccgatcactatcgtagataatgacgaatgtgaagatggaaaagcgttaagaatctatacccgggcaggtgaagagtatgaaggtactaatggggaccgtttcaaggtgcagacaacaacgcaattcggatcaggtcgttatgaatggaggatatatgtccctaaattcggaatgaatgaccgggccagtattggagcatttttatattttgacgatgggcatgaattggattttgaaatttgttccggtacagctgcagaccgtgcagcacatagtgccggaccagatgatatgctgtgccttgtgactagtcaggctaatccttttttctctgaattcacgcctattaagggggatgcttggcatacgtttgtattggatttgaagttagaaaataagaaatatctggcggagtggtcggttgatggtaaagttttaaagagggcacaattagattatggtgaagaggcttatttccgtgctatatctagtgtcgagaatctttatggtatgggcgatcatgcggcaactcaagaaaattatgccttatttgattatcttgaatatgttccttatgattattcaatgaagccgattatcgaaggtcagcttcctcccgaaccagagggaacaacagtgaagtgggactttgaggaagctggttttgttcctgttggatggactaacaatggaggaacgattgcggatggaagtttgaatctatctaacgggaataacttcgtttatggtccggagataggagctggaaaatatacatgggaaatagatgttcctttggtaggggtaggtgaaaaatggttggcaggtggtaatatcgctgcaactaatgctgaagaaaggtcattctctatgtttgttttctcgggtactgaaaatgatcgtgcggcttgtacggttcctcctgttcctggtcagatgctggtacgttgttatacggaagctatgggagtttacggtgtacctattgatccgggtaaacacactttgactattgaccttagacttaatgcagatggtgcatattgggcggcatggattatagatggtgaagtggcgaaaacatttactacttggtatactccggcacagtttaaatttggattctcaatgatgacctttgctgatggaggtggctggcaaggagataagcctactgcaaagacatatacagtcaaatatgactatatagaatataagaagtataattatgatgaagaataacagtttactttacattcaatgaggtatttaagtataattggaacagctatatgctgtgtaatgttggtaatgacgagtgtttcctgcaagcaggaaacattctcttccaccacccaggagaagaaagtagctccttggtatgtctatatagatggaagctcttttaaggatatagagccagtgaaagagattattagttccattagcgttttcgggaatcctccgaaatcatttatcgatgaatgtcatcagaatcatatcgaagtatatcaggctgtaggtgggaatgaagaaacgattgatacgccacagaaaagaaaggcgcttgttgagaagtatgtaagtgattgcaatgcaaacggatatgatggaatagatcttgatctcgaacatttgaaccctgatattcaggatgcatataccgaattcctgaaactggcttcaaaagaactccatgctgttggaaagaaattaagccattgcgttagtttttatccggctttgtatcaggataacgaaactaagatgtttcacgatccggcagttttgaatactacttgcgacttagttagagtgatgtgttacgatatgtattttgcacctgggatagataagcccgagctcaaacatagggatgattgtatgggcattggacctacgtctaattatctatggactagagaggcgatgcttttctggatgaaacatattccaaatgataaattagtgatggcgttgcctgcttatgcaaatgattatgctgtaactggcggcatcaaaggaaggcagatttaccaatctgtgcctgacagtataaatggaattttgccttctcctatctggttatgttatgaaaaggtaaacatgtatctgtatgatggtactgatggtaatcggcatctgttttatgcaagtgatgccagaagtacggaagcgctacttgaactagctgatgaactgggaatctctcaaatcggtttttggcactttaatagcgtagatccgcaaatgtgggatactgccgcaaagtggcaaaagaaataataagataataaatcgaccttgtaaataatatagctttattctcatccccccatttagagaaaagttattcttaacaataagaggccgcaaaggtatgaatccgtatctttgtggctttttatttttttcttacctttgggggacttaacataacccccaaaaatgaagaacatgaaaaagatctttttactcattttcgtcattctatttatttttccggtacaggctcaacatacattgagactgatgacttataatattaaaaatgcgaacggcatggatgatatttgcagttttcaacgggtagccaatgtgataaataatgcttctcctgatgttgtggctatacaagaggtagacagtatgacccgtcggagcgggcagaaatatgtgctgggtgaaatagctgaacgtacacagatgcatgcctgttttgcacctgctatagagtttgaaggaggtaaatatggaatcggactgttgacaaagcaagttccgctacgtttacaaactatccctttacctggtagagaagaggcccgcaccttgattctggcagaatttgaggattatatttattgttgtactcatctgtcattaacggaaggagatcgcatgaagtccctggaaatagtgaagtcattgattgcttcctataaaaagcctctttttctagccggagatatgaatgctgaacctgaatccgatttcatcaaagaattgcaaaaggattttcaaatactctccaatccggaaaagcatacttatcctgctcccgatccaaaagaggccattgattatattgccgtgtcaaagcaaaacgctaccggatttgctgtcatatctgcgaaagtagttaatgagctaatggcttccgaccatcgtcccatacttgtggaattgcgtaccgctgaaaaggcagacaagatattccgtactaaaccttatttgcagaatcctgtgggtaatggcattactgtgatgtgggaaacaaccgttccttcttattgctgggtggaatatggcacagatactacccggctggaacgtgcgcgtatgattgttgacggtcaggtggtctgcaataacaagctgcataaaatacgtatagatggcttacagcccggacagaaatattattatcgtgtgtgttcgcaagagatgttgctttatcaggcatataaaaaggtatttggaaatacagcacaatcgaccttcagtgaatttactcttcctgttgctgatacagagtcttttaccgctattgtttttaatgatttgcatcaacataccaatactttccgtactctatgtaaacaaatacaggatgttaagtatgattttgttgttttcaatggtgactgtgtggatgatcctgtggatcacgagcaggcaaccacatttatcagtgaactgaccgaaggagtgtgtggcgatcgcataccgactttctttatgcgtggcaaccatgaaatccgcaatgcctattctatcggtttgcgtgaccattttgattatgtgggagataaaacttatgcctcttttaactggggagatacccgtatcgtcatgttggattgtggagaagataaaccggacgaccattgggtatattatggcttgaacgattttactcaattgcgtaatgaacaggttgattttctgaaaaaagaactgtctgccaaagaattcaagaaagcaaagaaacgtgtccttattcatcatattccgctttacggtaattatgaaaagaatctctgtgcagatctgtggactaaattattggaaaaagcaccttttaatgtcagtctgaatgcacatacccataaatacgcttaccatccgaaaggggaactgggtaataattatccagttattattggtggaggatataagatggacagtgctacggtgatgattctggaaaagaagaacgatgaattgaggattaaggtgctgaatgtaaggggagaggttttactggatataacagtctaaagtctctaataactttataattcatggaggtgcgccagacttctagacacacctccatgaattagttatttcataaagtgctattcggagaaatatgtataatagaaattctctatatatccgtcatagtttttgctttcctctttgatacaactattttcgtcatattcgaatgtgtaagtagctgtactggatgaatgttgccaaccactgctcgtatggcaattagccgaagcttttccaaagagaccagtttcaaccagccaacgactagctccactgctttccgcatagatgcaatgtgctccgctcacattaggcacggcagaataggtctgaaccttaaactgctctactccatctgaaaatctggtccattgcataatatttccattttctatggtgatgttagatgcaatattgccattcttttcaactttggtcatgtagccattctcatcataagtatattcgtaagtgttggaaccatctacaaaagttgcaacataaccttggtcatttaaagtcatgttatatgcgttcttacctgtcactgtgatattatttccgtcataagcaaagagccattctctatccaactctccttcatatagcctgtagacacgtttaaccgtaccattgtcattatattcgtaataccatttatcccagtcgtccgcaaaagtggctatccgataaactgttacttcagaggttgttgtaaaagtgatttctgcatagtctgaatcttcaaaatagattgatccggttttttgagcttttactttgaatgtataacttttttccggctctaaacctgtcagttgaattgtattttggtcagtactttgttcactaccgttgttcaagctataaatataagctgttgcgtttcctatggctttccatgtaataacagcagaactctcttttacatcaggaacagtaacttccggtttatccagaatgtttgtactgggatgattgtcgtcatcactgcaagcagtcgtacctagtactactgccagcatggctaataagtaaaaatactttttcatgttgttctatttaaggttaataattagtttccggcaactactatcattcccaaaccaaccaggaagaagataaacatcaaggccagtagttgattaacagatttcgttgaacctttaaattctttccagataaatactccccaaatagcggcaataagtggtgcgccttgtcctagtgcataagataccgccggaccagcttctcctgatgcgatatagctgaacgcggaaccaagtccccatatcgctccaccaagcattccgcatatatgagttttcgtgtttcctttaaagtattcggagtagctgactttttctccgacaaaaggacatttcattactaatgtgttgaaaacaaaattgcttagtaatacgcctattgaaaaaacaaagatggcagaataaggagtcatcattcctatagcaggagaattgaagttttctacgtccatacctttcactacgaacctgtagaacaaagacatcagtacaccggcaattaatgcaatgataattccctttttgttgtttttcctgctttcttctcccttttgcatttttccggaagccactccattgcaaatgatagcaataacaatgagagctacaccgccaaataaaagcaaaggattaccagttggaattcccagataattgacgattacccctaataccaatgcaatgccaactcctaaaggaaaagcaacagacataccagccaaggaaatagacgctgaaagaagaatgtttgaagcattaaatattacgccccccaagataacccaaccaatgctgtctcctgatgcttgtcccagatcttccaggaatgaacgtccggtatctccatgactacccattgtgaagcctagtaagatggtgaacaataccattccaatcacataatcccaataaaaaagttcataacgccaatttttggaaactagtttttgggtattaccccaggaaccccaacaaatcatggttacgatgcagaatataactgccaataaataactgtttactgtgaacatactattagtatttaattgttaaacatgaattctgttatttaaatatagtatccaatcttcccaataagtgaaaacattggcttctttacattttcttgaccggaactcatgttccaggtccgattctttcaaaaggatatgtatattactactaaaaccatattcttttgattcggggagtatctctatccagcatctgggatatcttttgtaagagttgactgcttttataagattttgagcatcattttcgttgccgatggcatttacacagactatgccggtaaacaaattttctccctgaatggcttctataccttctttgatattatctcccaaagtgattaaagcccgcatacgttgggaacctctgatgccggagagttgcttttctatatcagaaattgtttctgacaggtctgtgttagcttttacgaaacaaagaacagcaggccatgttttattctcatctaccatttgatgaaactgactgacgagaaccttttgctgttgttcgttaatttctccctgtacatagataataggatattttcttgtgcttccttgagcctgttccggataatagaccgttgcattggctgtttggataaacggagtctcattcggaagactactctcactatttcctgaccgctttccattgaaatattcgtttatgaatctgaatgctttgggcagtgcagtattccagcaggtgaaatcatgtcctcctgaacgtacttcccattcatgaggtatttgtctttccagtaataatcggtgcagttcttcattactttcgcaaagagtaccttctttatctccaatatccagcatgatgccaaatccttttaaatcggaattgcggagggtggaaagaatgtggtagggtgaatgttgtttatagtaactggttaggcgctgcttaccattctttcccactcctccgaaaatccgtccccattgattgtcccatcctttttgtggcccttcttctatgtattgtttttctgtacggatggatggcgataacgcaacgacagagccgaataagtggcggttgcgcaaactaacggataatgctccgaatcctcccatagagaaaccaatgatcgagcgtccattaatatccttgcgagtacgatagttgttatctatatatggaaccagttctttgataaagaaagtttcataaagggaactgccatcataagtgtcactgtaataagacaggtaaccgtcaggaataaccataatgaaaggttgaatctttccttcttttatcattttatccattacacgggcaacgttgccgtattcgagccaactggtataatcacctcctattccatgaaacatgtataagactggatattctgtttctgaatgttcataaccttccggtaagataatggagtaggagacttcttgctttagggacggactgtaaatactcatcccttctttttctatgggaagtgcccaagctccatctatacctgatagaaataggataatatataacagtatcttcttcatattatttctttattaactgttcaccaatataataactcattgaataaatacctgtttgggcggactgttcactatccagcccgtttctgacacgatattgcaccggagcttctgcacctcgcaatccattgaacagagtaaagatgctattgtagttgctgccttcgtctgttatgtccaaataatagattttggcacgattctcggcagaaaggttgataatatctgcgtcttctgcaaagaaaaagttgatagcaggggcattgcctgttgactgattgtataagtaatcagcttctgaaccgtatgttaatcctaatctgaaatctgcattgctttccgtatgaaccgtcttttccacagcatcggtaatagctgaaaaatttgtttcatttagaatcatttctttcacattaaaacctgcaattatcatacgtttgatttgcataagagaatctaatgccactgctaccttctttgttgtaagatcaacattaccttctcctttgctgtaataaagaactttgtaagttagttcggaattgtagtcatccggtaaccatagttcgatattggaattacctacttttatgtttttattagtagcatgtaattcctctgtgaattttttcagagtttcctgcggatagttttctcctttgaatgaacgttcgataaaaggcagtgcctctttcatggattcacgccaataactgtcagtatgggcaccgtttcgtacacgatattcgtgcttgatatttttgtcccgtaatagagaatgtaattcaccgtttcctgcatatagtctttcttcatcatcaccgcagtctatgtaataccgtactgtttgaaatgtggaacttggtttatccttgaaaaagtgtagcggacattggcttttataatagcttgtcagcctgcctgttcctgtctggccgcttcctccgaagttgtttccccattgaagattccaaccgtcttgtgacaaagagatgtattgttcatctgtatttagagagggacttaatcctattgataccgagaatgtttcaggatgttgcgatgctatacttaatgccccgaaacctcccatagagaatccggcaacagctctttccgtcttactggctgttgttcggaaccgcttatcaatcaggggtacgagttcattaatgaacatatccatatagttgaactttccgtcatagcggttgcaaaaataagtgttgaaaccttccggcatgatgtagatcaatgggcgaatactaccattgctggtttgcgcatcagctatgctttgaatattcagacctgaaggtccccatgaactttggtttcctccccagccatgtagaaggaaaactactccatatttacccgtactttccgatagatactcttgaggcagtaatacggaatatttgatttcttgtcctaatattttgctgtaaaaactttgatcgggattatagcgtttggtaaacagttccggtgtatcggtctgttcgccttcggacggattgttatcatcagacgaacatgatgacaatccgtaggaaaataataataaggctaataataggagtagttttctattcatggcttctctcttttatttataaggattgattggctctgccggtgtggatgaataaaccaccatgtctttacattgaacggcatatttttcattcggattaatccatttaataaccagtttgtgaggtccttcctctaaatcataattatagaaaatgtcatactttctttttatgtagtcataaggcatttctatggtttctactttcttgccgtcaatgtaggcctccaggatggcgatgtaattgtcattactatctttaacatcttgcctgatcatccccattaaaacaactcccttgccattgaactcaaatgttttttctgtaccgagatcatatttgataactcttctttcagaaggatataagccttcaaaagaaacttcccatgctacggtttttggcttctgaatcgtggtatagtatttatctccttttatttttcctccgtttgcttttaatacatcactcaatagtttgagattaatgtcgtatacagaacttaaagagatatctgtgtaagggaacttaatattttcacatctttcgagtgccggtttccagtattcggggatagccttgtagccttgtatgactccaagaattcctgcggcagttgccgggttacagtcggaatcttgtccgcaacgagtggctatatccattgttttgaaaaagtcgccgttgccatataaaagtcccatcacacagtaagccgcattgatagtggcgtcaatgttaaatgcattgaataccccttccgggcagccaatctcaaaagcatgccggttttctatttccagccagcatttacgccagtcatcgggatattgtttccaatatttaataacgtctgtgatgcaacggtgaaatttactttgttcgggtattgttttaagagcttccgtgacaattgtataaatgtcgttatttacgtaagccaatgcatacattgctcccatgtatacacctccataccatccgtcgccgtagttcatgatatgccctatcttgtccgaaaaattggaggcggtatttaccatccccggacatatcattccaatgaagtctgcttcaatctggaaatcaatatcgtcagcgtgcggattatttttccaatgtcccgatgctggtggcataataccgtgcaatatgttatatctggctgcctggttggcatgccataatttgtaatctgcgtttgcaaaggctttggcaaatgattcggcaggggcatttatcccttctttttgcattacttccagaaaggtaagatccatatatacatcatcatacaatcccggatcttctgcaaagatgtccttgcaatagtcatcataccagattattggagttttctcatgaatgatcgctcctctgtatttaaattctgtaggaccgccataggtgcatcctatggtttgtccggcccagcctcctttaattttgtcgagcagtacctctttacttatttcaactgtttttccatattctatttgtgccattcccgatatggaaaaggtaaatagtagaatgatgttaatcaggacttttttcatcttaacttatttattaaagtaaaatctatcatgttcttttttctctgaataatacattatgtcgttgatacgaataatgtagtcttttttgcggttcaaccatttcattttaacgtggtgtcttccttctttcatgaggtatttccaggctggttctactttgcggtctgtgtttctcatgggtaaagctgctacatggtccagttctccgtcaatccatatttccactttagcaacgtaagggtcattgggctctgccaatccgaacacctcggaaccgatgtggcgtgtagatacacgattgatataatcgggagtaatacttcttgtgcagcaaatgttgccccagataacaaatccgttaccattgaaatcaaattcaaatgtatctgtcaggaagcagtctttgcgttctctataaagtggataggtgttttcgaaattttgttctaaaggaagtacatccgcctttttgattggaatttctatctccccaccagatacttttccacctgttttgactatgagttgtttagcttgatcgaaactcatttggtatgcttttgccaacgacatattcgttccttcaaatgtaaagtcttctacttctttcaaagggtttaaccagaatgaagggattttatcatacccatacatgacgccgagtacaccgccgactgtagacggattacagtcagaatcttgtccgcagcgtgttgcaatatcgatagagttggtgaagtctcctttaccgtagagcatagctaatgctacgaaagcggaattgagcttggcgtcaatattaaagtttagaaatacgcctttgggacatcctacatcgcagttccatttttcttgcaggaagtaccagcaatctttccagttgtccgggtgcaaagaatggaaattgattacatcctgaatacattgatggaatgtactcttttcaggtatggcagagattgcggtttttagaatcgcttcaggacttttttcatagaaagcggagctataaagagctgctacgaaagcaccgccataaaaaccgtcaccgctattcataatgtggcctactctggaggcgatatccaatgcttccggcagcattgccggagccatcagaccaatgaagtctgcttcgatctggaaatccagatcgtctgcatgtgggttattcaaccaatgaccggaagccggtggcatgataccttggcggatattatatctgcctgcttggttagcatgggccaaatgataatcagcgaatgcaaatcttttggcaagttcttcttgtgaacaatccaggccaagttcatcaaatgcctcaacaaacgtgcaatcgttataaatatcatcgaacaatccgggcttcttttcccaccaatattttacgtaaccttccgcccaggggattggctggtaatcttgaatataagttcccgtgaacttaaactctgtaggtgctccgaaaacaacaccaatggtttgtccggcccatcctcctttaatcttatctaaaagttctttatcagataactttaaagtttttacaggctgggcttgtacgttgagagcaaaaagccctataatacatatcgtaattattttcctcattcttctcctcctttatttctcataaactcccaactcggtgatagagatgaatgatgatacattctttgtgtatttatgccagtgttcctgcacttttgcatccattagtacgcgtattcccttggtttctactgccgggaattccaaaacatattgtgcaaacggaggttggaaaaatacaatatcggtttcgggaagtgccggagttgatttgaatttacctacgtcataccaatgtccgtcatttccaagatattgaatgtttagagaagtaaaccatcctccgaactcttccagacagcccatatctaaaacaagcatattgatgttatgctcttctttccaaccgtatccgaaatagtctattttaggcagattacttttggccgctaatgaataaaatacagatcctacgccatctttgactccgtcattaattacttctacatttgttgcgtacatcggttttccaaaggtaatccagcaagaatcgagtacttcttcgtttagtttgcgaatatttgcgtaaatagtgtcagccttgggggctatattcttggttttaaccaataactcaaagtctttagtaattgagttcttgttatttgcgcttaattgaagggtaattggatatttgccggcttctgtaggagttcctgccagtttaccgttttggaatgtaactcctaccggaagtttaccttttaccagttcccatttgaaatcagcgtttgttctgcaggcaaatgagtaatcggtaggctgtccgatttccaagtccggattcggaccgatacagaattccataggggggatgaattgtgctttggggttaacatataccatatcaccctttacttttcctcctttggcacaaaccagttcgattgctttgttgtaagtacgttcaatcatgtcttcaatggaagcatcgggcatatcaaacctggtgatattgatataccggtcgttgaagggtttttcccatccttcgataggtttagtcaaactttcgggaagagactttgcaccatacattactcctagaagtccggagatagtggctgcctgattgtcgcagtcaaatcccattgcacagcttaaatccaatgtccgttggaaatctccttcgccatacaacatagccaaaatcccgcataatccgttcagattagcattccagattgtttttgtcatggctggttcatctatgtaatattttttagccatgatttgacgtgcttttacccaatctttaggatatttgtcatataaagcaatcatctcttttacagctatcgcatatctgtcatcagcaggtagttctttcaaggctcgtgtaatcagtttgcggatatccttgcagaaaaaagcgtcagcgtacattgcaccatataggacagtgggagataccgcccacgaatcgcttgtgatacgggccgcccaatcactttttcctgcagcatatgaaatcattcccggtgctgtatacgcccatatctcgttaatcaattgagggtcgatctgataccagtgcggattcagattttcgtcacctgtgaacggaggggtgaatccaagatgcattaatccgagtgcagccctattggctagccatacacggtcacggatatgatacatccatccttcgcgcatattggcataagtaggttctacaccatatttctccattaatagtaagtagatatactcaacatcagtatcgtcatcagagaatgcaccgttatacttctgcaatttatctatgtttttagtgtaaccgaatggaaatctggattccggggcaggttcatctacaaacttgttctcaaaaggaagtccatatatatttcctaccatttgcccgatccaagctccagctattttgtcttttaactctgtctttgaaattttctgtgcagagataaataagatgttggtaattaaaacaagtaaaaagatgattggttttttcatacttatcagggttgatttgttggaaggtacacttttctatgtgaaccttccaattgtggttaataatctttgttttgagataattttggatttgcatttaaaatatccgtaggaattggaaatacatttctaaaagtttctgaactttggtcagggtgtgcccaatattttttcagatattttccgaaacgtatcatatcttcatggcgccatccttcccatgccagttctctgcctcgttctgcataaagttcatcaaccgtcaattggcttgtagtatatgcatcaagccctgctcttgtacgaatcttcttgaagtctgccagttggatggcctcacttgttctgttttgtcgtaccaaagcctctacatacattaatacaacatcggcataacggaagatggcaaagtcgttgtccatactaactgtatattcttttaaagaaccatcagtctggtaatgccatttccagcagcgtgcaccgtcgtatgtgccacgtcctccgttgctattgtaatatttttcttcggggaagacaggagtatattcgaaaccaagatcctttccgcttaggtctacttgaggaccgtataaccagctctgacttctgcgaagatcttgttctgcgtatgtttggaaaaagtccggttggcagagaaaacccgaccatggggctgccggaatattaaatgttgcttgtgatgcagcttccaatgtcagcgtatgcaaataaaatgagttactgtcaccgctagtatatactctgtcatacaggattacaaagatattctccttagaatcttcattttttatatcaaaattagtagaataagagtcttcaatgctgtaagcacctatatccataatatctttacaggctttctctgctttgtcatacattggagtaccgaaccatgcttctgcattcagatacattttcgcaagaatgcaataagcggcagcttgtgtggcccgtccataattagtatctgaaggctccctgtctaggaactcgatattgtcattaatttctttttccagatagttgaaaatatattcacgacttttttgttccgggtatccggtttccgtgtagtcagttgtgaaaggtacgtttccccaacaagaaatggcttgataatagtagaaagcacgcaatattttcatttcagctataatcttctcttttccttcaaactggataggtgataattccgtttcgtaaataatttcattacatgcagcaataccattaaatatccagttccatccccttgtcaataatttatttgcaggtggaattttattcgtctggatttcttcataacgtccattgctgtaccaggaaccaccacaagcgggaacggcacattcatcagaagcttgtaaaagcaatgtccataaactttgttcggaattgtatccttgtaatttcgtatacgctctacctgcattggctaccagttctttctcatttttaaagaagtcattcatcgctactcctgtgtatacagtttcgctaagatcggtacatccgtataataatatacagataacgaaacttaatattatatttgtctttttcatggtaatcttatttttttagaatactatattaactccaaaagtaaattctgttgtacgcggataatagctcaaactttccataccgggttccagtccggaaagagcaacttctgggtcgacaccagaataaccggtgatacagaatacattctgtgcagtaagagacaatcttagtctttttatcattttggatgtgaaatcccaagtatatccaaaggttacattatccagttttaaataagaagcatcctctatatatttggaggaatatttataggtcgtacttgtgaaattcgtttgagataaccagtttgatgagatatttctaagtccgatgctgcttagattttcatattccatcgcatagttgttcagaatttctccgccgatagatgcacgcagtgagaaactcaagtcgaatttcttatatctgaaggtattactccagctaagagtggcatccggataagcacagccaattttttcccattgttcttccggtacggaaccgtctgcattttgtcctagcaatacatcttttccatctgtatcagttcctaaccatataggaccatagaaagtacccaatgactgtccttctatcagacgttgagtgtagcaggcagcacttgtagaccatcccactttgtatgttccgttagtgaattcatcattggtgaatttcaccaatttgtttttattgtgcgaaacggtaagtgaggtattccatgtaaagtccctagtgttaaaaggtgtaccggatattgttaattcaactccttcattagtaacttttccaacattcgtaaacaaggtattatatacataaggaggtgttggcacgatgtagtcatatagcaagtttgatgtagtccgtttgtaataatcaaaagtgaacgagaggtggttgtcaaacattgtcatatcgacaccaacgttgaactctgcttttttctcccattttagatccggatttgcattacttgcaggttgataagtattgatccattggccattgtaatagaatttaccggctgtagtcatcatcatcaaagatttgtagtttgagaaatcctggttaccggtaactccgtatccggctctcaattttaaatcatcgatccatttgacattcgagaggaatttctctttatttatacgccaacctacgctgacagccgggaaccatccccacttattattgtcaccgaaacggctggagccatcacgacgtagtgaagcagacaaaagatatttatcatcgtagttgtacataaaacgtccgaagaatccgatatatgtattatcttctttattggacgacatgctggctttgccttcagttagattcgttcctgttccgatgttatgagtctggttgtcatcgaagtcgaaaccggaatttgtcatggatgcagatgtgctgtaagtatactggtatgtatatccgagtaatacctgaatggaatgttttccgaaaatattcgagtaatttaaagtagactcatattgtgtatcgttttcctgatagttttcaatataggcttgcccgtttgttcctattaaacttggataataatgtgtgtagtattcacgtgtctcatattgttccttgtcgtatgaaacaaagttctcccattttaatccttttataggcaatatgtttagagtagcacgaatatttgcaccataattatcattcttactttccatgttcctttcgttaatgatcgctaccggattgtaatattccattgctttgatacggctatatcctccggcatccggatcgctgtcgtcataaacaggctctgttggattatgggtaaatgcctgcataaaagcacttgtagaggaagggctgtatttgcgatgaatgatattcaggttataatccaaatcgacccatttatctaataatgactggcgaatattggtacgtgccattagcttttcggagctattatgcttttgcaagccatcgctcttttcataattgaaagaagtgtggtgtgagaacttctcggaacctccggatatagacaagttgtgcttatggctgaacggagtttgtgtaatttctttaaaccaatcggtatcactgtcaaaaatataactttccaattctgggcgatattccttgataacagatttgtattcgcttgccgataaaggttttgctctgcgtgaaacgactcccacggtgagttgcccatcataagaaacttccgttttgccacttcttgcacgtttagttgtgacgatgattactccattcgtacctcttgttccataaatagcagctgccgaaccatcttttaatacgtcaattgattccacttcctgaaaattgatatttctgatatctgcacctgccaccccatcaataataattaatggaccttggcctgcggaaagtgtgtttgttccgcgaagtaatacttcatatttggctgtcggatcagcaccgttcgggttgataatttgtaatcctgccacttttccttgcaacattcccatagcattggtgaatgttccgggattgaggtcatctttcttcatgctggtaaccgatcctgtaagctctttctttgtggtagagccgtagccgattactacaacgtcattaagcactttcgagtcttcgcgcaggtgtattacaagctgtgtctgatttcctacttgttgttcaacagttgcataacctacataagatataaccaatacatcagaaggattcgcttttacattgaaggttccatcaactcctgtaatagaaccatttgttgtacctttaacaaggacactggcaccgataatgggttcatttgcttcatcgaggactgtacctcttattgccttctgggcaatagcatcattgctcatcaaagaaaatactattaacaacatacttgtcaatagaccgtggattgaacattgttttatcataataacagaattaaggatgattattgtatttcttttctcaaaggtatagatacttgtgctcccattctggtaacagaaatagaagaggctttacttgcaaatataattgcatcttttagatttttgccctcagacagagctacgcacaatccgccgcagaatgtatctccggcagcggttgtgtctactgcttctaccttgaaggctggaatgtggataaactcattgttttcataggcgagagctcctttggctcccatcgtaataatgacagtttttatgcctttcgaactaatataacgaatcgcttcttttgccgattcatcatctgtaatgtgcattcccgagatgatttcagcctctgtgacattaggaataagaatgtcgacattggctaataaatcgtcaggcagttgttgggtaggggcaggggcgggatttaatataacggtaattccatcttttttagccattttggctgcataagtgacactctcgattggagtttccaactgcataatgacgatggatgcctgtttgatggcaggttctgcattttgtatgtcatcaatagataaagtcccgttggctccggaagcaacaacaatacagttttccccttttttgtcgacattgataagagctactcctgatggttcctgcggggtaattcctacataagtagtgtcgatcttttctttgtgaaacatttccaaggtttcatttccaaaaatgtcatttcctattttacatatgaaagtgacatctcctcctagtcttgcagcagctacggcttggttagctcctttgccgccatgattcattaagaagtttcctcccagaattgtttctcctggttttggtagacggtctgatttgataaccatatccgtattactgctacctatcactacgattttcttctttgtgtccatataatgagtattaagtattaaggcgaattgaatcgtaaacgatgcgcaatcgtttgcgcaaatatagaaatttttttcaaaacaaaatatttttcttgcttttttctcaaataaaatgttatttttgcaaaaaacaaccagtaatgaagaaaactctgattgatgtatcaaagaaaactgggtactctatctctacgatttccagagtgttaaatgggaaatcagagaaatataggatcagccagtctgctaaggaggttattttgcagtccgttaaagaattggactatcagcctgatatagttgcgcaaagtttgcgcaacaacacgacatatactataggccttcttgtaccacacatagataatcctttttttgccaatatagcaagtgttgtcatccgtgaagcacaacgttataattatactgtcatgcttatcgataccctggaagatcctattcaggaaaataaagctattgattcgcttctgtcacgtaagatagacggaattattttggttccgactggtgaaaacccttctaaactcgaggagattagtactaaaactccgattgtgctaattgaccgctattttgagaagcataatttgccatacgtagctactgataattatgtaggagcctatcaggcaacgaaattattattagaatcggggcatagtaagattctctgtattcaggggccggatatttctataacaactaaggaacgtgtgcgcgggtatcttgatgcgcttcgcgaagctggttatcaggataacgcaatgataagaggaaatgagttctcgattcagaatggttatattgagactaagttggctctgaactctactacaaaacctactgctatatttgcgttaagtagtacaattcttttgggagccgtcaaagcattaaatgagcataaagtgagaattcctcaagatatgtctatcatttcgtttgatgataacttatatctggactatctaaatcctcctataactcgtattgcacaatcactggagaatattggcattattgctgtaaaaatgttgatgcagaagattttggaagaaactgaactacattcggagattcttttgaaacctaatattataaaacgggattcgataaaggtgttaactgatagaaagtagtattttagataatagaaaaaatcgggcttgaacaatgtcaagcccgattttttacatattaataccgtttcttatgctgccggatctggtgcttcaccaccgccttcatttccaccttctccgttgccttcatttccattgtcaggcgtacttgacaccattgccttttgacaccaactatatgaatttataagtatcaagagttctgggctcagttgtaattcttggggattggggggatttgattcagggcaatcacatccctaaaaattgattcattccggtactattttgagctaaattcatagttacaaggactaatctaacgcaatacagtttttagtaattcttcttagaactattattttcttcgttccctaatgagttttcgttccacttaagtggagcgatagttcaacttaagtggttctatcgttcgacttaagtagaacgaaaactgaagtgcagatctaattattatttataaaagccaggaaactaaatacagtattaagacaggttatctcttactgactattggaagctactgtttagttcatttccgtaccggaatgaatctatttttaagggtgtgattgccctgaatcaaatccccaaaattttcagattgagccgggttctggtggaatcactcatatgtgaggtggatgttgctcattctttttcaggtaaagacactaatttatgcattaaatgagaaaatacgatatcccccctttatattttcttttaaaaacgatacctttgaagtgttttctttcttttttatcaagtatggattgatttccggcaagttctcctatatttcccgaattaatattcattaacttatttgccgtaatactttttaatacctcttgtgtattagctaatagatattgaactattaactttaaagactaatattatggaaaaagattctcctttttcatccaccggcagaaggtgtattgtaaccctaatgtgcatatttgtcactgcttttgtttatgcacaacagcaaaaaatatcgattagtatcaaagagcttcctcttaaagaggctatcagtcagatagcagagaaggcatcgatgaatgtagcctatagcaaagaatttgtggatacgagtaggaaagtgtcattggaggtaaaagacacagatgtaaacaaagcactaactcttttgctaaaagggactaacattgggttccgtttcctggatgacagtattttattttataataaagaatatcaaaataaaactgaacctattgattcgcaaggagagaagaaggaactgtatgtgaaaggtaaagttactgacgagaatacggaaccgatcatcggagccaccgtatcggtaaaaggatcgactacaggtacaatcaccgatatcaatggtcagtattccatcaaggtaccctatggaagtacacttcggtactcatacgtcggctaccgtgaagaaagcgtcatagcgaaagcaacgacaataaacgtggtgatgaaagagaatgctgtcagcctggaagatgtagtagttgtaggctacggcgtgcaaaagaaagtgaatgtaacaggtgccgtatctatggttaaagcggaggctattgagaaccgacctattactaacgtaactacagggctacaaggattgttgcctggagttagtatcgtttcctcttcggggcagccgggtgctgtgcccagcatcaacattcgtggtacgggaaccatcaatagtagtacagcacctttgatcttgattgacggagtagccgggggagacatcaacttattgaatccttcggacatcgaaagcgtatcagtactgaaagatgccgcctcatcagctatttatggagcacgtgccgctaacggtgttattcttgtaacgactaaaaagggagaaaagaaagagcgcgtagtattccaatataacggatatgccggattccagactcccacagcattgcccgaacttgttaatggaagggaatacatggaactctccaatgaagccatgagtgctgccggattttccaagccctatacacaagaggctttcgataaatatgattcgggattgtaccccaacgaatattccaatacagactggattgacgaaatatacaaaagccgggcttttcaaacggggcataatgtaagtgcacggggtggaagcgagaaaaccggattttttatgtcgtatggtttcctggatcaggatggactggttgtaggtgacggatatagttccaaaagacataatgcgcgtatcagtgtaaacacggaggtgtatgatcgtctgaaactgactggacagatgagctatgtcgatttctataaaaaggacttaggttatagcggcacatcaggagtattccgcctgtcacagcgtatgtctccgttacttcccgtcatgtggcaaattcctgatgagaatggccggatggtagatagtgagaactggtcgtacggttcggtacgtaaccccttgcaggtagcctatgagtcgggaatggaagaacggaaaacacgtgtgctcaatggtattttcaatgcagatctcaaaattatagacggactgaacgtaggtatgcagtactctgctaatatatatacccgccaggtggatgagtttaacccgaagatgttgtcttattactcggacggtagcccgttgaaagcaaatgaagatgccaaggactatatctcacaaagccatcttgacgttatgacccaaacgttgcaattcaccctgaactttaataagaccataggacgccacgagttgggagcattgttgggattttcgcaagagtgggaaaatagaagtacgttgggggctacgcgtgataatgtgatggttgaggatattcacgttattagtgccggaatgattaattttatgaatagcggaacaaaagacgagtgggctttgcgttcttactttggtcgtgtcaactatgcttttgacggtaaatacctgtttgaagctaacctgcgtgccgacggaacttcaagatttgccaagggcaatcgttggggatattttccatcattctcggcaggatggaacttctcacgtgaaaaattcatggagttcgctacttcggtattgagctcgggtaagctgcgtgcttcctggggtgagttgggaaatcaaaacattcccggtaattactacccctacttgtcacctatcataaccgaagagtcttatcctatcggagcttctaatacacctgttatgggactttggcaaaacaaaatcggtaatcccgacatcaagtgggaaaccatccgcatgcttaatttcggagtagaccttagttttttgaacaatagactgaatgtggactttgattggtataagaaagaaaatattgatgcattggttcgtcccgatgttccggctattgtcggggtttccagtagtaacgtaggttatgtcaatcttggtaagattgatgtcaaaggatgggaacttaatctgtcatggcgtgataagatcggaaatgtaaattacaatctcgggttcaatctgtcggacgctcgtaataagattaccgatttgggtggaactccggagtcgctgaccagtacggcttccggttcgtatcgtcgggtcggtgatccgataggtgctttctatggttatctgactgatgggctggcgcaagtgtatgactttgaatcagtgaatacaactacaggtaagtaccagaaaccaaaatttcctcttgttgcatcacaaaacggcattgtacagcccggagatattaagtatcgggacatcagtggtcctgacggcgctcccgacggggtaattgatgactacgacaaagtggtgtttggcgagaaagagccccattacacctatgcaatcaagggtggtttagaatggaaaggcattgatttcagtttctatttgcaaggagtaggcaaagttgccggttaccttgaggatgaggctcggcatgcgtttatcaatgactactcaatccctaaaaaagagcatcttgacagatggacgcctatgaatccaaatgcttcttatcccagactttatcagtcgcaggagcacaataggctcttcagtgactactggaaagaggatgcatcgtacttgcgcctgaagaatattcagataggttatcgttttcctgcccggatggtggcacctcttggcattaatagtcttagagtatatgcttcggcagataacttgtttactaaaaccgattacttcggagcttatgaccctgaagtgaggaccaccagcggagatgtctatccgcaagtaaaaacctatgtttttggattatcaataacattctaacctattaaacgactataaagatgaaatactcaaaatactttttaatcattgctttctttggtatagttacctcatgtagcgattttctggatagaacgaaccctaacgagccggacaatgtaacattctgggtaaatgaagatcagcttaaaaatgccttgcctccctgttacgaagctttacaaaaagactatctcgtgaattggagtgaatcgacggccgaaactgttatgtgggggaatattactagtggactaagtaaggtttccggaggcaagcactcttatactgacggcttccccttcactacctattggacaggagcatatagctatatttatcgctgcaataattttctggacaactataataaagcgcaggtagctcaaaataagaaggacgtttatgccgcagaagtaaaaaccatccgggcgcttatgtacttttaccttacggtgttttggggtgatgtaccttgggtaggagaagtcatccagcccgaagatgcatatatcgaacgtactcccagagagaaagtcattgaccagctcgtcgaggatttgaaatgggcggcagagcgcatgcctgaagaaaggtatacaggcgacaaactgggaagactcgaccgctggggcgctttagccatattggcacgtattgccttgcaaaacgaaagatgggaactggctgcaaaaacgagtgaatatatcatcgaaaacagtccctatggcctgtatgaatacgaaaaactatttcatcacgaaggggatgtcgagaatgatccgaaaaatatcgaagccatcgtatatagcctttttgtacccgaaatccgtacacaaagtctgcccaatgaaacttgcagtccgacggactatatacgcctcaatccaacgaagtcgttagtggatgcttatctgtgtacagacggtaaaccggcaaaaaccggattggaatattataaaaagaccggtgtgcagacctcatcgttatacaagtcgcctgaagagcattatgtggattatttccagaacagagatcctagaatgaagatgactttatatgctccgggtgacaaatggccgggaggagatgacggtgatcctgatacggataaggccaacgagatatttaatctgcctcgttttgcttcattgcaagataataaccgtgtgggggcaaatagccgtacaggtttctatctgaaaaagtataacgatattgatttggccggctcaagtgtgggtggacatgggaatctcaatgtcatccgctttgccgaaatcttgctgatttatgccgaagccactttcgaactacaaggtaagaaactgacacaaacacagattgattactccatcaacagacttagagatcgtgtgaatatgcatcgtatgaaccttgacgaacttagcgcatgggggatggatctcgaaaccgaattgagaagagaacgtcgcattgagttggcaggtgaaggaacaagatacgccgatgtgatgcgctggcgtgaaggcgaacttcgctttggacgtgccatcaccggtcccagcctgaaagtttgtatgaacgatttgggtgccaacccatatcccgataccggagtagatgagtttggtgatgttatctacgaaaagtctaccgcggaaggcggcgcgcgttacttcgacgcaacgaaacattatttgtggcccgtgcctaatcccgagcgtcagaagaaccctctgttaggacaaaatccgggctgggaaaagtaatcatttaaaaatagaaatcatgtattcaatgaagaaatatttattattgtttttatgcctgactttgggcgttgcctatgcgcaagatactttacgggtgcgggtaatgacctataatttgagatttggcgaactggcatctttagaggaacttgctcatcacatcaaatccttcaagcctgattttgtggcgcttcaggaagtggatagcaaaacagaccgtaagcgtaccccgcatcagaaggggaaggattttatatccgaacttgcctatcatacagggatgtttgggctttacggaaaaacgattgattattctactggttattacggtattgggatgttaagtaaatatccatatatttctgtccaaaagataatgctgccccatccggtcaaagagcatgagagacgggccatgctggagggattattcgaaatgggtaatgataccattgtttttacctctacacatctggatgtcaactctcaagaaacaagggcggagcaaataaaatttattaccgggcatttcaaaaattataaatatcctgtaattttgggaggtgatttcaacgcgcgtcattactccgaggcaatacgtggtatggatagctggtttgctgcaagcaacgatgattttggaatgccggcatggaaacctgtgattaagatcgattacttgtttgcttacccgcaaaaaggatggcgtgtgattagcacacaaactgttcagtcgcttttgtcagaccatttaccgattattacggaattggaatatgtgaaagaagcatcgaagaaaaaatattgatactcacttataacatttatgattttctatgatacatacaataatcaagtatttactgatttcaacaacgctttttttctgctcatgccacaagcctaagacggatattatcacccccgccaaacagttaatagaacgtcagattggggaaagagcacagtctatccactttgaatatatcgaaccatccgacggtaaagatatattcgaagtgatagcaagcgacggtcggcttaccctaagaggaagtagctccgttgctatctgttacgcttttcatacgtatatgaaagaagcttgcaagagtatgaaaacatggagcggtgaacatataacatcgatgatgccgtggcccgattatgaattgtatgaacaagtctccccttatgagttgcgctatttccttaatgtttgtacattcggctacactaccccttactgggactgggagcgttgggaaaaggaaattgacaggatggctctttatggtgtaaatatgcccttggctaccgtggccagcgaagccattgcggaacgggtatggctgcgtatgggattgaacaaagaagaaatccgtgagtttttcactgcccccgcacaccttccctggcatcgcatgggcaatctgaacaagtgggacggtcccttatctgatgcatggcaacagaaccaaatcgctttgcagcatcaaatcctgacccgtatgcgcgagttgggtatgcagcccatagcacctgcgtttgcaggtttcgtgccggaagcattcgcacagaaacatcccgacacacaattccggcacatgcggtggggtggttttgatgaagagtacaacgcctatgtattgccaccggattcaccttttttcgaagagataggcaaactgtttgtcgaagagtgggaaaaagagtttggagaaaatacgtattatctctcggatagttttaatgagatggagctgcctatcgataaggaagataaagaagcgaaatataagttattggccgagtatggagaaacgatctataaatcaattgcagccggaaacccggatgccgtttgggttacacagggatggacattcggatatcaacattcattctgggataaagaatcgcttaaagccttgttaagcaatgtacctgatgataaaatgattatcattgatttgggcaatgattatccgaaatgggtgtggaacaccgagcaaacatggaaagtacatgatgggttttacggaaagaaatggatattcagctatgtacccaactttggtgggaaaaacaccatgacaggagacttggacatgtatgctagttcctcggtcaaagcgttacgtgccgcaaataaaggtaacttgattgggttcggttctgcccctgaaggactcgaaaacaatgaggttgtttacgaactgttagccgatatgggatggtcatcagatagtatcgacctggacgattggatgacgatatactgcgaggcccgttatggaggatatcccgatgctatggaggaagcttggaaactttttcggaagacagcatatagctctttatattcatacccccgttttacctggcaaactgtaattcccgatcaacggcggatcagtaaaattgaccttagtgatgattacttgcaggctatacgtttgtatgctagttgcgctgacgaactgaaaagctctgaattatacagaaacgacctcatagagtttgtttcgtattatgtagcggctaaagctgaaaatttttataagcaggccttgaaagatgattcggagaatcgtgttctcgcagcgcaacgtaatctgcaacaaactgttgatttgttgatggacgttgacaggctgttggcctctcatcctttatatcgattagaagaatgggtggaacttgcgcgcaatagcggaacaactcttcaggaaaaagatgcttatgaagcaaatgccaaacgcttgattacaagttggggtggtattcaggaggattatgctgcccgtttctggagcgggctgattaaagactactatatccctcgtatacagctctattttacaaaagaccggaataaaatccgagaatgggaggagcaatggattacatctccctggatcaacagtacgactccgtttgatgacccggtcgaggctgcattgaatttaatagagaaaacaaataagtgatagcttttatgaaaaagattgtattggcattcgactcgtttaaaggttcggtcggttcttttgagatagcaaaagctgccgaaaaagcgattcaggaggaattacccgactgtcagattatacgtttccccatagctgatggcggcgaagggactacagaagctctatgctctgcccttcatgctcaaacggtgtcatgtcgggtgcatgatccattcatgaagccaattgaagtatcgtatggcatcgtaaacaatggtgcgatggctattatcgaaatggcctcggcctgcggtctgccattgattgattcaaatcgaagaaatcccatgaagactacgacttatggagttggagaaatggttgctgacgcattaaaacgcgggtgtcgggaattcattatcgggatcggcggaagtgctacgaatgatgcgggaataggtatgctgaaggctttaggtgcacgctttttagatagcggaaacggtgagttggagcctgtcggcgaaaatctgataaaagttcatcaaatagatatttcccaattaaatccggcattgaaggaaagtcattttacgatcgcctgtgatgttagtaatccattttttggagaagagggtgcggcctatgtatatgctccccaaaaaggggcaaatagtttgcaagtgatagagttggacaatgggttgcggcattatgcacaggtgataaaggaatatacaaatatggatatatcacagcttcccggtgctggagcagccggaggaatgggaggcggcttgcttccgtttttgaatgcagaattgcaatccggaatagaagttatattgaaaacgcttcgtttcgaggaggtcgtccgacaggcagacctgatactgaccggagaggggaaactggatcgccagactggtatgggaaaggcgttggacggaattttacgtgtcggtgagaaatgtcaggttccggtgatagcgtttgggggagcggtcgaagccaccgaagcgcttaataggatggggtttactgccgtactgcccattcaaccttttccggtaacacttgaagaggcgatgcgaccggagtttacgaaagaaaacatagagagaacggtgcgacaggtggtgagaatcataaaacaatttactaaataatactcaatgacagcgataggcgcattaatcgggctttcattatccatactgttaatcataagaaagctttctccgacatacagtctgattatcggagcgatagtcggagggttgttgggaggactatctttaaatgagactgttacggtgatgaccgaaggggtgaaagaggtcaccccggcggtattgcggattctgacagccggagtcttgtcaggcatattaatacaaaccggagctaccacggtcatctccaatgcgattataaacaaaatgggtgaaaaacgggtatttatggcattggcactcgcaacgatgttgctttgtacggtaggcgtctttattgatgtggctgtgataaccgttgcgccggtggctctttcaataggcaagcgtctaaacctgtctccatctgtattgcttattgctatgatcgggggaggtaaatgtggaaatatcatatcacctaacccgaacaccattatagcagccggaaattttaatgcagatctatcggctgtaatgtttgccaatattttgccggcagtgatcggtttgtttttcactgtttttgttattgtccgtctgatgcctcaaacagtgaaaaacaaaaaaacgatgatgcaaacagaggataaagaggaagagagaaatctgccttcgttaagaaccagtctgattgctcctgttgttacgattgttttattggcattacgtcctgcggcaggaatcaatatcgatcctttgatagcgttgccggtaggtggtttatgtggtgctatctgtatgaaacaatggaaaaacattcttccgagtatagcgtatggactgcaaaagatgtctgtggtagctattctgttgataggaaccggaactattgccggcatcataaagaactcttctttgaaagactggattcttacaggattggatcatgctcatattagtgatgcattgattgctcctatatcaggcgcgttgatgtcggcggctaccgcatcgacaacagccggagcaacactggcttcttcttcgtttgctgaaacgatattggctataggcatttctgcggtttggggggcagctatgattaattccggagctacagttcttgaccatttgccacatggctcgttctttcatgcgacaggaggcgtatgcgaactcaactttaaggaacgtctgaagctgataccttatgaatcgcttatagggatagtgttagctgccggaacgactattttatatataataagtaattaaaagaatcaaatattatgaatccgaacaaacggctactttcgcttgatgtacttcggggtattactgttgccgggatgatcttggtcaacaatacaggaaagtgcgggtataactttgccgcttttgcacatgccaagtgggatggcttttcgccggccgatctggtattcccgatgtttatgttcctgatggggatttcgacctacatctccttatgtaagtataacttccagtgtcgaccggcgattgcgaaaatcataaaaagaagtctcttattaatatttattggtctggttatggagtggttcattacagcaatagatagtggtaactattttgatttgagtcagctccggttgatgggagttatgcaacggcttgggatttgttatggtattacagccttattagctgtaacaataccgcataagcggtttatgccattagccatcattttgctggctgtttattttatttttcagttatttggaaacggatttgagaaaagtgcggataatatcgtcggcatgattgattcggctattttaggatctaaccacatgtatcttcagggccgccagtttgtcgatcccgaagggatacttagtacgattcctgctgtgtctcaagtgatgatcggttttgtttgcggaaagataatcattgacattaaagacaatgaccgccggatgctgaatctatttcttataggtaccactctgttgtttgtcggctatttgttaagctatgcctgtcctttgaataaacgtttgtggtctccttcgttcgttttgcttacttgcgggattgcggcattgtcattggcattgttgctctatatcattgatgtgaagcagaataaaaagtggttttcgtttttcgaagcatttggagcgaatccgcttgtaatttatgtgtttagttgcatagccggaggattgcttgtgcattggcatatccatacggctgtattcaataatttgcttaacccgttattcggaaattatttcggttcatttatgtacggtgtatttttcctgttgttcaatgggctgttgggatatattttgttaaaaagaaaaatctatataaaattataaatcagaatgaaaagaaaaagtgtatacacgtgtctggttatgctgcttatgtcgttggctcttcaggctaaagacaaagacgtagctgttgcggaagcattattgaaacgtttgctgccgtcatacatcgagagttttcagtttcaaaagttaaaaggagagaaagactgctttacgatagagtccgtaaaagataaaattgtaatcggtggaaacaacgccaattcaatggcgatgggactgaaccattacttgaaatattactgtctcactacagtgtcatggtatgcggatatagccgttgaaattcctgaagaattgccgatggttggtgagaaggtggtttcggaagcgagagtggatactcgctttttcctgaattactgcacgtatggttacacgatgccttggtggcaatggaaagaatgggaacgttttattgactggatggcccttaatggtataaatatgcctttggcaattaccggacaggaagctgtgtggtataaagtttggtcgaaaatgggaatgtcggacatcgaaatacgctcttacttcacgggaccgccgtatctgccctggcatcggatggctaacatagatcgctggaacggtccgttgccgatggaatggctggaacaccaggtaagcttgcaaaaaaaaatactcgcacgtgagcgtgaattgaatatgaagcccgtattaccagccttcgccggacatgtacctgccgatttaaaacggatttatcccgaggctgatattcaacatttaggcaaatgggcaggctttgctgatgcataccgttgtaattttctgaaccctaacgatgctttgtttgcgaaaattcagaagctatttcttgatgaacaaaaaaaacttttcggaaccgatcatatttatggtttagatcctttcaatgaggttgacccgcccagtttcgaacccgaatatttgcggaagatagcttcggatatgtacgctacattgacggctgccgatcccaaagcccaatggatgcaaatgacgtggatgttttattttgataaagataaatggacttccgagcgaatgaaggctttgctgacaggagtgccacagaataaaatgatattacttgattatcattgtgaaaatgttgaattatggaaaagaacagagcattttcatgatcagccctatatttggtgttatctgggcaatttcgggggaaacacgactttgacaggtaacgtcaaagaaagtggcgaacgacttgagaatgctctcattaacggtggaggtaaccttaaaggaatcggctctacgctggaaggattggatgtgatgcagtttccctacgaatacattcttgagaaagcatggaatctgaatgtagatgatgataaatggattgaatgtctggctgacagacatgtgggatgcgtgtcgcagcctgtgcgcgatgcttggaaacgattattcaatgacatttatgtacaggtgccgcgcacattgggtaccttacccgggtatcgccctgcattgaataggaacagtgaaaaacggacaagtaatgtgtacagcaatgttgaactactagaggtctggagaaaattgaatgaggcaccttctgaccggagagatgcttttcgcctggatttgattactgtaggcagacaggtgcttggaaactactttcttgatgtgaaagtggagtttgacaggatggttgaagctaaagaccatcaggctttgaaagcttgtggcgagaaaatgaaagagatattgaatgatttggataagctgaatgcctttcatccttactgttcgttggataaatggattgatgatgcacggaagatgggggattctccccagttgaaagactattatgaaaagaatgctcgcaacttgattactacttggggtggaagcctgaacgattatgccagccgttcgtgggcaggactgataagtgattattatgcaaagcgctgggaggtgtatatcaatacattcatcaaagcggtcggggaaggtgtagaggtggatcagaagcaacttgaagatgaattaaaagaaatagaagaaggttgggtaaatgcaactgatcggaaggatactcgaaaagatgttcattcaacaactgacggattattatcattctccacctttttattcagcaaatatcaaagactggtgaaataaataagaggcctgttttatttgttgctcgcgattcatgctatatcagaaagaattaatatatttgaaaataaggacttaatataataagttttttattttcatatttaaaatgattaagatgtcccagaaatactcacaggatgaagcccaagctttggttaaggctctgaaagaggggaaccagctggcatttagtattgtatacaagacgtatgcggcgcagaccttttctttggcatttaaatatttgctgaataaagaattggctgaagatgctgtgcagaacttattcttaaaactctggctgaaaaaagaagaaatcgacgagacaaaacctataaacagatacctttttacaatgttgaagaacgatctgctcaatacgttgagagactcaaagaaaaatatctatttacttgaggattgcctttcaatggttttggaattggaagacaattctcaaaacgaaaaccttaaacaagaacaaatgaacatcatacagcaagctcttgagcaactttcgccacaacgccgcaaggtttttgaaatgaaagtttcgggaaaatactccaatcaggaaatagccgataaacttaatctttcgatcaatacaattaaatttcaatatagccaatctttgaagcagattcgcgcgacagtgggagagcttagcctattgttgctttattgtatgatgtagttttatcactttttgctgatatggaacgttcttttgaattaacacggtttaacgtagtctgtataatacttttttgtaacagtgtgtattactaatagatattgaaatatgaaatcaaaaaagaaacatacaaatcaggactttgaagtagttgacggcatcgggaaatatatggatgacgacattcagaggataatagaaggcaaacagctcgaattgggcgacagagaattgcctccttttgatgaatatcgcatttataagaatattcaggcagccgtgatgcgggaagaaaaacgaaagaacaggagaataaggatgccattgttctttaagtggacggtagcctgtgcaattgttttgctagtgataggtgtgggatataatttctatcaaagtcataatgaggcaaaccttgtttatcgggaggtctgtgctgtaaggggggagaagctactcgtattacttcctgatggtagccgggtgtggttaaatgccgattctaaattgacctatccggaacagtttgcaaaatacaacaggaatgttacgctggaaggagaggcttattttgagatagcagaaaacaagaaatccccttttcaggtgcttgccgagaatgtgaaaatacaagtgacgggaacgtgtttcaatgtaaaagcatacgcttcggataaggtaatcaaaactacactcgacgaaggaagtataaatatcgggcatatgcaaagccgcaggcctatgcagcaaatgcttcccggacaaactgcagtttatgaaaaaaggagtaatgtaataaaaataaaaactgatagatatcacgatgatgcttcgagttggaaaagcaaccggcttattttcagaaatgcatcattgaaagaggtgcttacaacactctcgcgtcattttgatatagagattacagttaaaaacgaaaagattgcttcgtttacgtacgacttcgtttgtaaagggaacgatttgaactatgtgttggaggtgatgcaatccataacaccggttagctttaaaaaaatatcagaatatacatataccgttgaataagtaaacttaatctaataacaaaaacaaatttatgaaagcacttttaaagcccattgtatgggtatgccttttcttttttgcgtatcaaagtacgtatgcacaggctcttaaaataatgagctataattgccggatgtccggggaaatgaccggttactcggtgaaggagtatgctgtatttatcaggaaatacaatccggatgttgtaatgttgcaagagatagattacaacacaaaaaggaataaaaatcaggatttcaccactcaattggctgcggagttgggattgttttccgtattcgggaaagcgatggatactgggggtggagaatatggagtagctatcctttcaaaatatccttttgtttatatcaataacaaaacttttgaagggatagacggggccaaagaaccccggacgctattatatgtagatattcaggaaccgggaacttcagacgtaatcaggataggaacgactcacctggatcattcgacagacctgataaggagtgcaatggccgaacagattaatgaacggattggtacgggagataccccgacactgctggggggagattttaatgcccggaccgactctaatgtgatttgtgaagtcatgaagaactggcagagaatctgtgatgatacattcacctatcccgcagatcagccgacaatcaagattgattatatattcggacttccacagaataagtggaaagtgaagtcgtttaaagttttatctaatccggaagtttctgaccacagggctttgtttgctgaagttgaatttgtaaaatgaatgaaatatgaaatcaaactatctatatctgctatttatatgtgtcatctcttgcctgttcgtttcgtgtagtgatgaggataacaagggagaagaaattccggaatggaaccggttcagaacaactaacgtgttagtttatgcgcacttgtcagagcaaaatttatttagctcttgtagttataaagaggtggcgtcatctatcagaaacactgttcattcagtggcattgctggacaggacgaacgctgtctatgggcaaacagcaatcataaatacgggtacggagactgctagagagagcaagaaagtgccggtgtttgtacctgtcagctatagtaacggagagaaaaagataatcggcagtacggttctttttccttctactatttccgaaatgacacaatatgtagtaaaaaacgattgcagatatcttgaaacaaaaacagaagcagtgaacggaatagatatgctcttctgttctgtatcattaaatagtgaagacctgatagctccggctgtcgacgctttcaagaaaaaggtaaacgaacagacggttctggtaggcactgttaaacgtgcgttattgcctaatcttgagtcggcaattacttctaacttaacttctgatacctattctttcgtagaagtggaaaatagaaatagagactccgagtattgtatatttgtcctgacttcacataaatgggcttttaggggggtaaccgaaacaagtgtaagcggagatttacattgttttcaattacaaattgaatctttaaaataaaaaatgaacggtcatgaagcaatatatcaaaaatataatgatcctgatacttgccctttcatggggtttgttgttgacaaattgtagtgatagtgagtccgattattcggacgacaacgcatatccgccacctactgtagagctcacttctccttccgaaatagatgtggtggagtataactcgacggtgactgtatctgccagaagtttctctgctgtgggtatacacagtatatatgctaccttgttgaagatggatgagaatggagaatatgaagagataaacgcgactgaacgtcaacgtttaaagatagatactctgcaaactgatatgacacttgaatttgacttgaatgtcaaggtcaacacgcgtgaagcagccgggatactggtaacatcaacggatgttttgacaaaaacggcacaaaaggtaatacctattaaaaagataaccaaacttccatcccagatattcaccgaaccatcagatttctctgttttagtacccgatgaagaggtttctctgtctgtagtgattcgttctgctgtgggcattaagtctataaaacatacattgtgtaataaagtactgggtgacctgaaggaatatacgactattccggtatcaggcaatccgttggaaatggaatttatcctgaaaactgtcgtagacaataaagagaccaatggaatcaagattgtggtagaagatatagaggggttgaaagaggaaaagattatcaatatcgaaggtcttgagggtgttgacaataatgttgcgcttgttttcaacgatattgaaatggcgcctgaatgggaacattcaacagaaccggatcaaccttatattttctccatagagggaatcatgatacaaggtgtgcaaaagcatgtattaagcctgaaggaaattaaaggatatggctcaaaggcaaacggcgtagactttgctttcattaatatatggagaaatccaagctttgttgccgttaaaaacagaggtttctcctttgtcagtgcatcaagaattagtggaggaccaatagggagagcttatgacgtgaatgactggatcaaaccggcaggtgttgctaccaacaaaacgttgtttactcttatacctgatgataaggttactgatcttggtattgatgtgatgatggcgaacgcggcttcggacgtcaagacttttgaggcgttgaatgtattggaaagtatagctaaaggaggtgccgatatgttaatgcaaagagtcaatgcgtctgatggatatccgaatgatccttgtagtttgcagataaaagacggttcttatattgcctttgttactgcggcgggcaaatatggtgtcattcatgtcattgaagccgcaaatgataccgatgcgttagttgccggaggatgtaaaatagctactcctacaggagtggtaggaagccaggggccagcctactcgggagctggcataaccggactcacctatgacggtgtggcattactttacggacgtacctgtaagttgaaaattgtggttcaaaagtaaggttattataaattaaggaataaagaacaatacatttatattttgatgtaaaagtaaagaaaggtcggctcataaaagaaaatgagccggccttgtttttagatgtttctttaaatattggttataatagttttgatgttatctcattaatttgcgtatcaaacacgaaaatattattttcctttatgctttttgccggaaaagctataacttcgaagcactttttaatttgaataataaatgttagatttgaagcagcttacaactgatgtatgccggattgctaccgaagttggatgttttttgaaagaagaacgaaagaacttccgtcgtgagcgtgtggtggaaaaacatgcacacgattatgtgtcttatgtggataaagaatctgaagtgcgagtggtgaaagcccttactgctttattgcctgaagcgggattcattacagaagaaggctctgccacttatcaggatgaaccctactgttgggtgattgaccccttggatggaaccacgaattatattcatgatgaggctccttattgtgtgtccatcgctttacgtagccgtaccgaacttcttttaggcgtcgtttatgaggtttgccgggatgaatgtttttatgcctggaaaggcggaaaagcgtttatgaatggcgaagaaattcatgtgtcgaacgttgaaaacatcaaagatgcattcgtcattacagaattgccttataatcatctgcaatataaacagaccgctcttcatctcatcgatcagctttatggagtagtgggtggtattcgaatgaatggctcggctgctgccgcaatctgctatgtggctattggacgttttgatgcatggatggaagcatttctcggaaaatgggattattctgcagcggcactgattgttcaggaggcgggaggaaaggtgactgacttttatggtgaggatcatttcatagaaggacatcatattatcgcaacgaacgggaatcttcatcctttctttcagaagctcctggcagaagtccctccattgaatatgtaggtgctattgtaacttcaaattgctattattatgaaacacacacttcttatcaaagactggcttagttctttcttatctttgctatttccccattgctgcgttgtttgcggccggccgttagcaaagggtgaagaatgtatctgtacagtatgtaatatcaatctaccccgtactaattatcatcttcgaaaagataatccggtagaacggctcttctggggacaaatccctttggaacgggctacttcttttttcttttatgagaaaggaagcgacttccggttgattcttcatcggttgaaatatggtggacaaaaggaaataggtgcaattatggggcggtatatggctgccgaacttttgtcttccaatttttttcagggaattgatgtgataatccccataccgcttcataagaaaaaacagcaaatccgtggttataatcagagtgagtggattgcccgtggtattgctgctgtaacaggaatccccatcgatacagaatcaatattacgtaagaaaaatacggaaacgcaaacgcgtaaatctgtgtttgaacgtcgggataatgtggaaggtatcttcgagcttcagcatcccgaaacacttgcagggaaacacatactgatagttgatgatgtgttgaccactggttctactactctggcatgtgcttcctgcctagtgaatgtggaaggaatacggattagtatattgacgttggcaacggcttaaatttgtttcaagaatgtataaagggcttctcaaagatgactttattaaaaaagactgataaaaaaagcaaaaaatagcagatttgagcttttgttttgagtttcaagtggttgtggtagtcgttggctttaagtggcattcgtgaggaaatgcgaaaatggcggatttgagaagtggaaacgctttcaagtcattacctcaaagaaatgccctaataagcatatttaacggcttcggttcttacttctccattctgcacaggtttagaatttgccatgcaactctcatgatttaattttgcaccgaacaaaagcaaggaattatgagaagtacatttaagacagtcttctatgtaaatggaagcaaggagagaaacggaattgtccctatcatgggacgagtgacaatcaacggaactatcgcacagttcagctgcaagcagagcgtaagcaaggcgatatgggatgccaagggcaacagagcaaagggaagaagcaaggaagccaaggaggtgaactttgcgcttgacaacatcaaggctcaaatcaccaagcattaccaacgactttccgaccgtgaggcgttcgttaccgctgaaatggtgagaaacgcttatcaaggcataggcatggagtacgagacattgctcagagcctttgacaaggagaacgcaacctttgccaaacgtgtgggcaaagaccgagctgttaggacttatcgcaagtatcttgtggtaagaaagtacgttgccgagttcatcaagtttcagtacaagcgcagcgacatggcaatgaatgagcttaccgaggagttcatccgtgacttttgcctgtacttgaagaacgttgtagggcttacgcagtccaccatttggatatactccattccgttgaagcatatcgtcacggcagcacactacaacggcaagataccgagaaacccttttgccatgtaccacgttgacccagaccacaaggagcgtgagttcttgaccttggacgagcttaccgccatgaccgagataaagttggaagacccaaacatggcatttgcaagagaccttttcgtttttggctgttggacaggtatctctttcattgacacaaagaacctgacggaggacaacatctgtatgataaacggtgctccttggatagtttccaagcgtcaaaagacaggcgtgccgtttcaagtcaagctgatggatattccgatgcagattgttgagagatacaagccattgagaaaggacagccacttgttcaatatcggcagacttgacactatcaacaagcgcatcaagaaagtggctgcaatgtgtggcatcaagaaacgaatctcgtaccacgttagtaggcactcgtttgcagtattgtccctggaatacggtatgccgattgagacagtaagcaagatactcggtcacacgaacatcaccacgacgcagatatatgccaaggtgacaagcaccaagttggagcatgacatatcagtctttgaaaatcgaatcaaggggcatttgccaacaatgggaggaatggcatgaaaagaactgtaatcactatggacggaaatggagagttttccattccgtccaacttgcaagacttgtggatgattgagggtgaattggttgatatgcttcatgtcaccgccccgaaactccatgctgtgataaggtcaatgtacaaggaaggcttgtttttggtgtcggatgtccaacagaaaaaggaaacttccaagggcatttggcaaacgcagtatggcttcccgatgattgttgccctttgtttccgtataaattcatacggtgctgttcgatttcgtgacacaatcataaagaggttgtacggggcaaaagagaaaggtagtgtcattatcctacaactcaatggagggacaaacgctattaactgaatgtcctcttgtcgttggcttaatgctgtcgttctgtcacgaagaagtacagaagcattggtatgaagcagcttatttgatggggatagtcctaagccattaaaagggcggactaatccccttatttttgttgatttgttgaatatacagaaagtagtgttgaatatcaagtatttacggctctacatactctcaacaaatatctcaacaaaagaaagagaatgatgaaaagagaaatcctcaatgttcatgcctatgtttctcttttgcccagtgaagtgttgtgtagaaacttttgttgagaacttgttgataagttaagtctttgattttcattaccatacaacatattctcaactactcaactgaaaaatacccatcacttggtctgccgtagaatgtacttgtggatttattggcaaccgctctattctccgaaatggttgcagcaacgttccttggaggctttgcgcctccagccacttgggcaaacctccgcagtgttttagcatggcattagatttatgcagactataccgaggacacacagcgcatataacacactcggcatagttcacaaagtaaaacgacaaaacacaattactacacttggcaagttgcgcactgaatattatcaccttgtcctttgcacacttcaataacaaggtagtttgtatctgtgaccttattcttcaatgtggcagctttgatttttggtgcaaattgcgagaattaaggtctgcaaccttgggcatggagagctgaaaggcaaatgtctcgtcttttgttcttagaggagggagcgaggttatgttttgggaaccccaaaactcctcgctccaccataagggcggagaatttttgttcccaacggtcgcagaaagtgagtgtaccaactataaacagtatgtcgaattacaagcatgcatgaacaagccaggagaaagggtggaaaactgcccactaaaaggattcgcaagctgtcaaagtttgacacgaagaaattctctctgccaagctacgaggttttgaaattgatggcgagaaaaaccaatcgcaagttggctgagtatatccgtgagtccaccttgaacggcaagatagtccgtagaaacaacactgaaatgagaccatagtctcggtagggcatagatttaaccagtttatcctctaatcacatattcaaattcatcaaaattctcataccctaattcttctaagacttgacgactgtgttttctgtcctcttcagtgttgaacttgggtataatggggagacggagggtgattttatctttatgtttggcatgggagtagagccagacaaggttctcaataacttgctgattgcccttgccggtataggcttggtagatggcaggtgtcatgtccttgatgtcgatgatgaaggagtcgatgaaggagatgacttcctccaagtgatggcgaggcacattgaggctcgtctccatcgtaaactgccattcctcaggacattgctcgcaaaattccttgatgaatgcgcttcgcaagagtggttcgcctccaccaaagcagatgccgcctcctgtcgccaagaaataaagattgtccatctccacgttcatcatcagcagttccgtgtccatctcctgccatacgccgtcggcttcgaggcattggggattgaggcaatacttgcaatggagagggcatccgtggaatgccacgagggtggtgacaccctcgccgtctatcgtaaggcggtggcggtcgatgcaaatgagtggggcggtcttcattttattctaatctaaaggtaacggggactgtatatttcgtttttacggccttgccatttcgcttggcaggattccatttcggcatacttttcactacccgaatggcttcctcgtcgaaggtaggggaaatgcttttcatcaccttgatgtcactcagggttccgtcttcattgacagtgaaaccaacaatgactcttccttgtatattgcaatctccttgtatgtttggatagcggagattttgggcgatgtattgcatcaatgcagctgaaccgccagggaatgatgccatttcctcgattgctgcgccaaatagcttgctgctcttggtgtagtctgatgcgacggtttgttggatgatggcggtcttaccatcattcgtgtacttttcttgctttgcttcttctgaatgagtatctttcttgatgataggagctgttcctctgataactgcgacttcccccaagacatctctgctttctgtcaaagtgataatattgagtttctcttggctcatttttgtgattttgatgattctgtcttgcatgccaagatatttcacggtgattatatcttctttctccacctcgatagtaaagtttccatctttgtcagcaatagtcttgctgccagaaatttttgccgtaatcgtggctcctacttgtggatctccttgctcgtcaatgagatgcccttgtacaaaaagtactcctttcttgtttagtgcttctttttctttgaggaggacggaatcgtttggcgtatattcttgaaatagaatagggagggttttctctgatatagaactataatatcccttctgggtggcgcatgatgtggtggatgcggcgagggcggtgattcccaatgccactcctgcgaccttgatggctttcccggccatttgtctgattctcaactcatgttccaggtctctcacgtcttgctcacatcttgggcaagttcccttgcattcgcccttgaagtggcattcttcgggtgaatagtctatcccattggcatccgctatttgtttgcgaatagccttgagggtatcgcatatgttgcgtcctttggttttcataaattgatatttttaggtgttcaacattccctttatttacaaaatgggtatattgttactccttagtcataaattctaaaaatacccatttttataattctaatttcaaaagtacgaaaaacaatctacaaacgagaaaattttgctttgaattgttagaaagggaattgcatttaacatttctcatgtttttaatgctgtatatgaaacttatatgtgtttctttagatattgtacagttgcatttctgagacattttccgaccataatttaataatctataaaaacaacgcaaaagatgttatttctcagattttaaatttatctttgcaatcgtaacagagttgtttgacaagcaaggcaaacttatgtataatgaagaagttggtactattgccaagtcattacctctattgaggtgaactattcataaatagctcattttaagctgttcagtagattttagcagaattttttataaaaaaaacgagattgagaaccgaatgaattaataatttcttatatttgcactgtcgtagatcgacatgtttttatgtttttgaagaaaaaaagcgtttagctgatttctgtgcaagcgaaaagtcgaaaattcaaatgtgcacatgaaacagtaaaatgctccttgcgatatgcggggggtgtttcctgtttgtgcacatagggcttcgactccctcgcttgcggataggcaaatgccctaccgttttttttgtatatatagggtttgtaatagggcgcaaaccatcatttgttataaatggaaagaacaaaaaagatatgcccgctttctcctcaaagcaatcgtgtgatttgcttgagaatccccctcttggctgcattgccatacaatcaagaaatctctggctggacatctcttatggtattctttccttctttcatgtatataaaccgatttgaaatgaatgaagatagagaaataaacaggttcggctaagaccccaagacgaggtggtttatatccaaacggtaggactgcctcgtctattttttcattaaacaaatgaagtgtcacggcgaatccatagcagccagttggttgtggtttgctatttttcgccaagatttaatgttatttaaactttaaaggcaagtcaaatgggacagagtggtgtctgacggctaaaaggtcgaaaacattacatttatgtgtaactacttgcctttatcaagaaacgatgaggtacgaccagtatcagagggggactaatggatttatccgggaggttccccttattctttcgtctttgttctcaaactgatccccaaatccccaatattcagactaagccgccgttttcaaactgaaccgctgtctttggagtagtagcaaatcagcggggataaattttagattagtccgaaaaatcggggaacagtttaaaagtttgggtaatgtgcttcagggcagcctataccaaaaaagttcgttcctgcacagttttgagctaaacggatgcatgcctcgccaccgtatctccgttaggtgtgccaataagacttttttaattgcccaaacaaattatctttattgcctagtcagattatctcaattagctacttttacttcgtcccactataatggaacgcaaaagtaactatagtgtcccttacgttctactatagtttcccgtaaagaacactatagtggaacgaaataaaaatagcaagtggaacgaatctggataggcaaacggataaatagaaatgcccaattaaaatcatttcctatgaatagacgattcgactcattccatatgggttttgaacaattcgatgctcttttctataacatgttcaattcttccagctcctttacttttcttctgtattgccgataaacaaggagtttgcaggtgaatagccgccccttcaccttctcttcatcgtgaatcaagtcaaattgctactttcagattccaccattgagcaagattagtaaagctattttgtaattagtttcaaccctatttgaaactagatgtttctcggtgtgaaacggattgtttcaagccttaaaacaatttttgaaactaatcgctacaggagaagagatggtgaagttgttacccttcacccgcaaattccttgtttatcggagagacagagaaaagatgaagggggacatggaaaaatggaaaataaatatccaataagagaatttattcgattctgttgtgattcaataccacaccggttaatcactatttaattcctttttgtaccgatatgatgtacctacttttagagatatggttgttctgagccaaatcccacaagatatattattagtcctttggatgataagaaaggtgaataaatagaaaagccacccttctaggtggcttcttttttgctcttcctcttggacttgaaccaaggaccctctgattaacagtcagatgctctaaccgactgagctaaggaagaatgtttttctcaattgcgatgcaaaagtactaggtttttttgaaatatgcaatatctttgcaaaaaaaatattaggaatggacaaaataataggattgggcaacgccctggtagacgtactcgcaaccctgaaggatgatactcttttggatgaaatgggtttacccaaaggaagcatgcagctcatcgatgacgctaagttacagcagattaacacaaaattttcacagatgaaaactcacttggcaacaggcggatcagcaggaaatgccatcctcggactggcttgtttgggtgctggaacagggtttatcggaaaagtgggaaatgataattatggagaattttttcgtgaaaatctgcagaaaaataagattgaagacaaattattgacctcggatcgactgccttccggtgtggcatccacttttatttcaccggatggagagcgcactttcggaacctatctgggagcagcggcttctttgagagcagaggaactgaccttggatatgtttaaaggttacgcgtacctatttatagaaggctatcttgttcaggaccacgaaatgattcttcacgccattgaactggctaaagaagccggtttgcagatttgtctcgatatggctagttataacattgtggctaatgatctggaattcttcaccttgttaataaacaaatatgtcgacattgtctttgcaaacgaagaggaagcgaaagcctttaccggcaaggagccggaggaagctttgagagtgattgccaagaaatgcagtattgctatcgtaaaagtcggggcaaagggttcttatatccgcaaagggacagaagaaataaaggtttcggccatttcggttcaaaaagtggtagatactaccggtgccggtgattattttgcttccggattcttatacggattgacttgcggatattcgttggataaatgtgcaaaaataggttctattctctcgggaaatgttattcaggtaatcggaacaacgataccacaggaacgctgggatgaaattaagttaaatattaacaggattctggcggaataacaaaggattgagctacttttacgactcatttagattgaaagaggtatgaaaaaattgctgaacaggcagatagctattgttgcagtagcggtgatagccacagttgctttctttagtttcaagagtggagacgaccgtaatttccagattgcaaagaatctggatatatttaatgcgattgtgaaagaactggatatgttctatgtagataccattgatccgaataaaacgattcgggaaggaatcgataatatgctttatacgctggatccttatacggaatatttcccggaagaagatcagagtgaactggagcagatgattaaaggatcatttggtgggatgggttcttacattgcttataatacgaaactaaaacgttcgatgatttctgaaccttttgagggaacgcctgctgcaaaagccggtctgaaagcgggagatatactgatggagattgacggacaggatcttgccggtaagaataatgcggaagtcagccagatgttacgcggacaggcaggtaccagttttaagctaaagattgagcgcccgaatgagaaaggtggacgtacgccgatggagttcacgattgtacgtgagtctattcagaatccggcgattccttatactgccgtattggataataatgtaggttacattagccttagcactttttccggcaacccttccaaagagtttaagaaagcatttctggatttgaagaaacagggagctacttcgttggtgatagacctccgtagtaatggcggtggattgctggatgaagcagtagaaattgcgaattatttcttgccgcgtggaaaggtgattgtaacgaccaaagggaaaatcaaacaagctagtaacacttataagacattgcgcgagccgttggacttggatattccgattgcggtattggtaaatagtggaaccgcttctgcttccgaaatcttatcaggttctctgcaggatctcgaccgtgccgttatagttggtaaccgtaccttcggaaaaggactggtacaggttccccgctctttgccttatggcggaacgatgaaagtgactacctctaaatattatattccaagtggccgttgtgtacaggctattgactacaagcatcgtaatgaagatggaagtgtaggaaccattcctgatagtttgactaaggtattccatacggctgccggacgtgaagtacgcgacggaggtggtgtaatgccggatattgttatcaaacaggagaaattaccgaatatcctcttctatctggtacgcgataatctgattttcgattatgcaacgcagtattgtttgaaacatcctaccatcgttgctccggaggagtttgaggtgacagatgccgattataatgattttaaagcgttggtgaagaaagccgacttcaaatatgaccagcaaagcgagaaaattctgaaaacgttgaaagaagctgccgagtttgaagggtatatggatgatgcttcagaggagttcaaagcacttgaaaagaagttgaaccatgatcttgatcgcgacttggattatttctcatctgatataaagaagatgattgctactgaaattatcaagcgttactattaccaacgtggtaatatcatccagcagttgaaggatgatgacggtttgaaggaagcgatgaaaattctgaatgatccggtgaaatataaagaaatgcttagtgctccggctgctaaggaataaataaatatatttcaaacatagatatatgcggaaaacgcggttttgttaccaacaagccgcgttttctgtatatctatatttaattgtaaaagtcctgtaaggtcatgcccggacactgatatttgtgtccttaatcgatctttattgacgaaccaaaggcagggtaaaatagaatctgcttccctggccttcctgagagcgcaaccagatacgtccacccatcttctctactaacattctgcaaagagttaatcccaatcctgttccctgaacaaaatcgttgacctttccaaagcgccggaaaattgtggcaattcttgctgccggaatgccgatgccgctatctttaacgtagaactctacaaaatcctccttttcccgatagccgaaatgaatttctcctttcggggtaaacttcgtagcgttactaagcaagttacttataatttgtatgatgcgattccagtctcccgaagtatacatgtccgtatttacgtcgtccaaaataagtttgacaccgttttgcgtcttatgacagaattgttgttccagctgcaggcagatatctattaatttgatcgggcggatattgaattttagagaatcagcttcaagtgatgctagatccagaatatcattgaatagattcagcagcatttccgaatttcgttcgatgatttccgaatattgattcttctcttctgcagatgttgcgtaagtgattagtttggagaatcctacaatggcattgagtggggtacgtatttcatgactcatgtttgccagaaaagcagatttcagccggtccgactcttccgctttgattctggcagcctttagttctttctgttgctgggcattcgtctgttccgcctcccattgttgggatatatcacggcacatacacaacagatactctttatccaaaggaaagatacggttttcgtagtgatgtaaaacaccatccaacataagatcgtgtctggctgttgaactttctcctgtgagaatcaccttatccatattcttgcggacactttcataagcttctttgggcagaatgtcttttacgttagtggtagtgatattgttggggctgataccttctacgtgattagttgccggagaagaagcaagctctatgatattggcgtcatggtcgaagacggtgagcatgtcaggaagagcatccagtatccgggtactatatttatcacgaaaacgttctttggaaggagaggaagaatcagaagaagaatgagaggaaagaaaatctattttcttctctaattgttcgattatttccaaaagatcttcctttgttttgttttcgtaatttctcatagaagattcgttattattcattagaatgttgtagaagttgttttatctgttgcaaatataaaacaatattccgagatgctgacagcctccctagttattataatataaaaaaaacggatagcttttgccctactaatcagaatgttctatctttgcatccattatatataaatgatttacaatatgtctacagaattattctctactctgccctataaggtggcagatattacacttgctgatttcggacgcaaggaaatcgatttggcagaaaaagaaatgcccggcctgatggctcttcgcgaaaagtatggagaatccaaaccgttaaaaggtgcccgcattatggggtcgttgcacatgaccattcaaacggctgtgctgattgaaacattagtggctttaggagctgaagtacgttggtgctcttgtaatatatattcaacgcaggatcatgctgctgctgcgatagctgctgccggtgtaccggtatttgcatggaagggcgagactcttgccgattattggtggtgcacgttgcaggcattgagctttgacggcggcaagggaccgaatgtgattgtagatgatggtggtgacgcgacaatgatgatccacgtgggttatgatgctgaaaataatgctgccgtattggataaggaagtacacgcggaggatgaaatagaactgaatgctatcttgaagaaagtgttggcagaagacagtactcgctggcatcgcgtagcggaagaagtgcgtggcgtatctgaagagactacgacaggcgtacaccgtttgtatcagatgcaggaagaaggcaaattgctgttcccggcattcaatgtaaacgactcggtaacgaaatctaagtttgataatctgtacggttgccgcgaatcgttggccgacggaatcaagcgtgcaacagatgtgatgattgccggaaaagtagtagtggtatgcggttatggtgatgtgggtaaaggctgttctcactccatgcgttcttatggagcgcgggtgctcgtgacggaggtagacccgatctgtgcactgcaggctgcaatggaaggtttcgaagtagtgacgatggaagaggcttgtctggaaggtaacatctttgtgactacgacaggtaatatcgatattatccgtatcgaccacatggagaaaatgaaagaccaggctatcgtttgcaacatcggccatttcgataatgaaattcaggtagatgctttgaaacattatccgggcatcaaatgtgtgaacatcaaaccacaagtagaccgttattatttcccggatggacatagcattatcttgttggccgacggtcgtctggtaaatctgggatgtgcaacaggacacccgtcattcgtgatgagtaattcatttaccaatcagacattggcgcagatagaactgttcaacaagaaatatgatatcaatgtatatcgcttgccgaagcatctggacgaggaagtggctcgcctgcatcttgaaaagatcggtgtgaaactgactaagctgactcccgaacaggccgcttatattggtgtatcggtggatggaccttataaagcagatcattatagatactaatttgatttacgattagacgatttaccatttacgattgataaataagggagatcgatattccactgttatcaattgtaaatgttagattgtccggtcgtatttatttttatattcaaacttcaatcgtaaatagtaaatcgtgtcatcgtaaatgaaaaagtttcttcctgacttaatagccattctggcttttatcattctttctttcgcctatttttttccggctgatatcgaaggtcgtatcttgtttcagcatgacacggctgccggagtcggtgcaggacaagaatcgaaagagtatctcgagcgtaccggagaacgtacgcgctggacaaactcgatttttggaggtatgcctacttatcagatgtctccgagttacgactcgacaacgtccctgaaaggggtggagaaggtttatcgcctctttctcccggattatgtagtgctgacttttatcatgatgctgggattctatatcctcttgcgggcgtttggaatatcggcctggctggcaggattaggcggagtgatatgggcattctcttcctatttcttcattctgataccggcagggcatatttggaagtttgtgacattggcttatataccacctacgattgcaggtgtcgttctggcttaccggaagaaatacctgttgggcggaatcgttacggccctgttcatcgcccttcagattcagtcgaatcacattcagatgagctattatttcatgtttgtgatcctgttttttgtaggagcttactttgaagatgcttacaaaaagaaagaattgcctcatttcttcaaggctagcggggttttagcactggctgccgtggtaggagtctgcatcaatatttccaatctgtatcatacgtatgaatatagtaaggagacgatgcgcggcaagagcgaattgaagcaggagggagctgctgccagtcagactagtagcggattggatcgtgattatataaccaactggagttatggtatcggtgaaacgttgacgttgctggttccgaatgtaaaggggggaggatcaggatctacgatgtcacagagcgaagctgctatggcaaaggccaatccaatgtataacggtatttactcacagttacctcaatatttcggtgagcagccgtggacagccggtccggtatatgtgggggcatttgtgatgttcctctttgtattggggtgctttatagtgaaaggtcctcttaaatgggcgctgctgggagctactatcttctcgattctgctttcatggggaaagaatttcatggggctgacggacttctttatcgattatgtcccgatgtataataagttccgcgctgtatcttctattctggtaatagctgaatttacaatacctttgttggcgatttttgccttgaaagagattttgagtaaaccggatatgctgaaacaggaaaagaactgcagaggagtgattgctgcgttggtactaactgccggtgtggcactcattttagctgtcgccccgggcactttcttctccagctttataacgacacaggagatgactgctttgaaacaagcacttcctgccgaacatttggctccgtttgtggccaatctgactgaaatgcgcgaagccattattgcttcggatgcatggcgcagcttctttattatagtgatcggttgcctgttcttattcttgtatcaactgcggaagttgaaagcctcttttacactggcgggtattgcacttttgtgtctgatagatatgtggagtgtcaataaacgctatttgaatgacgaacagttcgtgccgaagtcgaagcggtcagaagcattcgtgaaaacacaggcggatgagattattcttcaggatacgactccgaattatcgtgtactgaacttcatcggtttccccggtaatacatttaatgaaaacaatacagcatattggcataagagtgtcggtggctatcatgcagcgaaacttcgccgctatcaggaaatgatagaccatcacatcgtgcccgaaatgaaagaaacttatcaggctgtggctactgccggtggacagatggacagtgtggatgcttctaaattccgtgtactgaatatgctgaataccaaatacttcattttccctgccggagagcaagggcaggctgttcctgtcatgaatccttatgcatacggtaatgcatggttcgtagataaggtgcagtatgtaaataatgcaaatgaagaaatagatgctttgaacgatattcttccaacggaaacagccgtagtggatgtgaagtttaaagaacagctgaaaggtgtgacagaaggatataaagattcactatctaccatccagttaaccagttacgagccaaatcgtttggtttataaggcctccactcctaaagacggagttgttgttttctctgaaatatattatccgggatggcaggtgaatatcgatggccagccggtggatattgcccgtgcagactatatcttgcgtgcgataaatatgccggcaggggaacataccatcgagatgtggtttgatccgcaaagcatacacgtcacggaaagtattgcttatgcagcactggctttgttgctgatcggagttatggttcttgcgtggacgcagcggagcaagatagcgaagaagtcttaagcgaaatgtaatagagatcgttcaaaagccttgatcttataaaaatcacctttgctgcaacatattgtgcagtaaaggtgattttctttttagggacttttcaaactcatatcaaataagggcggctctcttcctcacgaagagagccgctactttacattcactaaaaaattatgaaaaacaaacgctgttcatagaaacatattaagtgtgatgttttagagatttttttgttcaaaatccggacccttgtcaggatgattatctttgtgcattcttctttgagaagcttttttacgtgcggaattttgttcggcctgccatttctcatactgttcttttgtcagaatcttttttattttcttttctttggtttctgcggctttcttttgtgagtcggcagaattggtatctctgttcatcatcggaccacctcccattctgcccgggaaaccaccttctcccatcattggcggttggcctccacccattggcggacgtcctccccgcataccgggaccttctcccattggtgggcgatagtcatccgaattttgcatagccttgaaaaatgctttttgctctttcaggttcagcttatatattttcttatattgtttatctgtcagttggagcaacttattcatttgctctgtcatctggattgctaccttctctggattcagaactttgcgtggaagatgcttttcttgttgctgcctttcttgcggctcataggcttcttgtgcatttataaaacctgcacaacatgttaagctgactgccaatcctatcaatttcatgttttttctcatttctcttactgcttttatttgttttaatatctcaaagctaagtagatactggagcagataaaaataaaatcgactaagggtggagatttgtctatcaaatgcctgacttttcttcgtccgatgggtttatgctattatgctttaggatggaggaaggttccccgccttgaaactacaacagtaacctattaccatactgaatatacgatgaataaagggtttgataatataggtgataggttgaaagaggattcttgtttttatctatgagagtgactgtccattcatttacccattgaaaaaggaaaatatgaatataaacaaatagtttgtggatagtctcattatgctataagctgctaaatttgtagccaataatagagcatatattatgaaaagactactattcattttttccttttttttcttgttcgtgttaaacggaaaaacacaggaggtagagattctgacattagaggattgcctccgcattggtattgacaataacttgtcgttagaagggaaacgtaaagaaatacaaaaaagtaaatatggcgtatctgaaaaccgttcgaagttgctgccgcaaattaatgcgatagccggttataataacaattttgatcctccggtgtcagtcacagacggttcatcttacggagttccctataatataacgaaaacattgcaacattctgctaatgcaggactggaaatgcagatgccgcttttcaatcagactctttatacttctatgtccatagctaaagtgatggaagaaatcagtcgtctgtcttatggaaaagccagggaagatgttattcttcaaatcagtaagatgtattatctcggacaggtcacggccgaacaaatcatgctgataaaagcaaatatcacccgtctggaagaattgagagatattacacaggctttcttcgataatggaatgtctatggaagtcgatctgaaaagagtcaatatcaatttggaaaatctgaaggtgcaatatgacaatgcacaagcaatgatgaaacagcaattgaatatgctgaaatacattatggattatccggctgaaaaggaaatcgcgctgacaccggtaaataccgatagcattactacggtagccctgaccggcttgtcggaaaatatctatgaacttcaactctcacaatcgcaagtgcaactggcggaacgacaaaagaagatcattactaatggatatatcccttctcttagtctgacaggcagctggcgatatgccgcatatacggataaaggttatcattggttccactccggtccgtccaatcaatggtttcgttcctatggagtggggctaaccttgcgtattccgattttcgacggactggataaaacctataaaataaagaaggcgatgatcgatatagagaacaaaaggctggcatgggaagatgcccggaagaatctgcaaactcaatatctgaatgctgtgaacgacctgatgaacaatcagcgtaactttaagaaacagaaggataactacttgcttgccgaagatgtgtacgcagtcacttccgaccgttaccgggaaggcattgcttctatgacggaagtgctgcaagatgaaatgcagatgagcgaagctcaaaacaactatatcagcgcacattataactatcgggtgactaacctgatgctgcttaaactaaccggacaaatagaatcattagtcaaataatacgcaaataacaatcataaatatggaaacaatggaaaataaccttccttccgctactcatcaggagaaagcaaaaaaaatgaagaaacttcgtcgctggcagattgctatcagccttttcggagtggctattattgtttggggagtgattgaagtgatctgcctttttttgaattatagccagacggagactagtaacgatgcacaaatagaacaatatgtgtctcctatcaatctacgtgcttcaggttacattgacaaaatctactttacagaacatcaggaggtacataaaggagatactttgctggtactggatgatcgtgaatataaaattcgcgtaatggaggctgaagctgccttgaaggatgcgcaagccggtgcgaccgtcatcaatgctacactcaataccacgcagacaacagcatctgtttacgatgcgtctattgccgagattgaagtacggttggcgaaactggaaaaagaccggaaacgatatgagaacctcgtgaaacgaaatgcggctactcctatccaacttgaacagattgtcactgattatgaagctacgcgtaagaagctggaagctacgaaaaggcagaaaaaagcagctctttccggtgtagatgaagtgtcctaccgtcgcatgaataccgaagcggctattcaaagagcaacagctgcgctcgaaatggcccggttgaatctttcctatacggttgtaatagctccttgtgacggaaaactcggccgtcgttcattagaggaaggacagtttatttcggcagggcagaccatcacctatattcttcctgatacccagaaatggatcgttgccaattataaggagacacaaatcgagaacctgcatatcggacaggaagtatttgtcacagtagatgccattagcgataaagagtttaaaggcaaagtcacctctatatcaggagctaccgggtctaaatattcattagtgccgacggataattcggcaggtaattttgtgaagattcagcaacgtattcccgtacgaatcgatttcaccgatttatcgaaagaagataacgaacggttagcagcaggcatgatggtagtagtgaaagccagactctaatccctccgcctcttctgtctatatacagtgccttataatttttaatttatatttttaattagtccgatgccctcttatcctaaaaattatcctttctatggttggatgcccaagccgttgggtattatcattctgttatttttctttctgccgattcttacggtaggcggggtttattcggtgaatagcaccgaaatgatgagcgggcttggcataatatccgagcatatccagtttgccaactttgttacttctattggtatggcagcctttgctcctttcctatatcagttggtgtgtgtacggcgggagaagatgatgtgtattgtcgggtttgcgttcatgtatatattcagttatatctgtgcaaagacagacagcgtttttctgttggcgctttgtagtcttctgacgggtttcttgcgtatggtactgatgatggtcaatctgttcacactcatttggtatgcgggtggaatggaagctacccgcaatattactccggggttggagccgaaagatactgtcggttggaataaattggacattgaaagatgtgtgagtcagccggctgtttatctgttttttatgattctgggacagtcgggcacagcattgacggcttggctgtcctttgaatatgagtggaaatatgtgtattactttatgatggggattctcctgatctctattttgctcttgtttattaccatgccgaattataagtttcccggaaggtttcctattaatttccgtaagttcggcaatgtcactgcattttgcatctcgctgacttgtctcacgtatgtgctggtttatggaaaagtactcgactggtatgatgacgaatctatccgttgggcgacagctgtaagtattctgtttgcgggaatttttctatatatggacgtaacgcgccggtcgccttatgttttgctggatgcgttcaaactgcgtactatacgtatgggagcattactttatttattattgatggtgataaactccagtgctatgtttgtcaatgtgtttgcaggagtggggatgcatctcgataatctgcaaaatgcttcattaggtaattggtgtatggtaggttatgctattggtgccgtggttgctatggtgttgggaggtaaaggattacattttaagtatctgtttgcgatgggattcttcttcctgtctttatcagctgttttcatgtatttcgaggtacagacagcaggagtttacgagcgtctgaaatatgcagttatcatccgtgctacaggcatgatgattctgtatgcgctgacggctgcttatgccaatcaacgtatgccttttaaatatctttccacctggatctgtattatgcttactgtgcgtatggttgtgggaccgagtattggcggagcaatttatacaaatgttttgcaggagcggcaacaacactatataacccgttatgcgcaaaatgtggacctgcttaatccggatgcttccacttccttccttggtacggtacaaggtatgaaatatcagggaaagagtgagacggaagcccgtaacatggctgctatatctaccaaagggcgtattcaggtgcaggccacgctctctgcactcaaagagatggcgggatggacaatttatggtgggttaatttgtatgatatttgtgctcgttgttccttatcctaaacgaaaattgctaacttagcgtcgtttttgataatgatctgttaatatattagtatgatggatagcggacaagatcgtttattgcagtttgaacgcgatttgttaagtgggaaaaatatatgtagctccgaagggatatttgtaaattttccaccctcactgaagaaaccttttcaaatgaaaggactggggctgattatttgccaccagggtaatttccagttttcgcttaatcagaaaaagcatttcgcaggagcaggcgaaagtttgtttattcccgaagacggcgagtttcaggttttgcaagagtcggaagacatggaggtgcggattttgatttatcagatagaaccgatccgggatattatggggaatctggttgtttccatgtatatgtattcccgccttactcccgaagaaccttcttgtgtatggtctactggtgaggaagaagagatcgtaaagtatatgtccttattggacaatgtgttacagtcggaagaaaattcatttaaactttatgagcagaaattacttctacttgcattgacgtacaggatttgttctatttataatcgcaaactcgtcaatgacgggcgggaagtgggaggacgcaaaaacgaagtctttattcacttgatccagttaatcgaaaaatattatatgcaggaacggggtgttgagttttatgcggataaattgtgtttgtctcctaaatatctttctgccgtttctaagagtatctgcggatataccgtgcaggaacttgtattcaaagctatcattcgtaagagcatctcattgcttaaaaatacgcagaaagatattcaggagatttcaaatgccttcggcttccccaatgcttcttatttcggtacgttctttaagaagcaggttggggtttcaccgcagcaatatcggaagaatctttaaacgtttattctttttcaccataggcaagatcgcctgcatcgcccagtcccggaacaatgtaagaatgttcgttgagttcgggatcgatggctgcgcaccagattgttgtcttgtcttcaggaaatacattctttatatgatcgatagccttttggctggcgataatcgaagcaacatgaatttcggcagggtgtcctttggtcagcattgcctggtaactaagttccatactccctcctgttgccagcatagggtcggtgataatcagcgttttgtcatcaatgcggggagaagcgatatattctatatgtatatcgaattttagcgtatctttatatttgcggtaagcggaaacaaacgcattctccgccccgtcgaaatagctaaggaaaccttgatggaaaggcagaccagcacgcaggatcgtactgattactaaattgttgtccggtgtactgaccggagcgattcccagtggtgtctggatgttctttaccgagtatttaaactctttactcatttcataagccatgatttctccgatccgttcgatgttacggcggaaacgcaggcggtcgttctgaacttctacatttctaatttcggatatgtactggtttagaatcgaattagtttggccaaaatcaattactttcatattattttttaatcagattttaatctcattttcacagcattgctagcatactgacttgcaaagtaaacgataatctttcaaattgcaatattcagtttgcagatattgttaggaatttataaaagagtttcaattagggaaaaatttctctaataccttcttcctttccaaagaaagtattacttttgtagccggatttacaaggggctatccaaagctccccatgttaaggtgaaaagagatagaaaacaaaataccaattttaattaattcaaagaaaatggcaaatttagatttaagcaagtacggcatcacaggtgtgaccgagattttgcacaatccgtcttatgatgttttgttcgctgaagaaacaaaaccgagtctggaaggctttgaaaaaggtcaagtaactgaattaggcgctgtgaacgtgatgacaggtatctataccggtcgttctcctaaagataaattcttcgttaagaatgaagcttctgctgattctgtatggtggacttctgaagattacaaaaacgacaacaaaccatgtactgaagaagcttgggctgacttgaaagctaaagctgtaaaacaactttccggcaaacgtttgttcgttgttgatactttctgtggtgctaacgaagctactcgtatgaaagtacgtttcatcatggaagtagcttggcaggctcacttcgtaactaacatgttcatccgcccgactgctgaagaacttgctaactacggagaacctgatttcgtatgtttcaatgcttctaaagcaaaagttgacaactacaaagaactgggcttgaactctgaaactgctacagtattcaacctgaagactaaagaacaagtaatcctgaatacttggtacggtggtgaaatgaagaaaggtatgttctctatcatgaactacatgaacccgcttcgtggtatcgcttctatgcactgctctgctaacaccgatatggaaggaactagctctgctatcttcttcggtctgtctggtacaggtaagactactttgtctactgacccgaaacgtaaattgatcggtgacgacgaacacggatgggataacgaaggtgtattcaactacgaaggtggttgctacgctaaggttatcaacctggataaagaaagtgaaccggatatctacaatgctatcaaacgtgacgctttgcttgaaaacgtaactgttgatgctaacggtaagattgatttcacagataagagcgtgactgaaaacactcgtgtttcttatcctatctatcacatcgaaaacatcgttaaaccggtgtctaaaggtcctcacgcaaaacaagttatcttcttgtctgctgatgcattcggtgtattgcctccagtatctatcttgaacccggcacaggctcaatactacttcttgtctggatttacagctaaattggctggtacagaacgtggtatcactgaaccgactccgacattctctgcttgcttcggtgctgctttcttgtcattgcatccgactaaatatgcagaagaactggttaagaagatggagatgactggtgctaaagcatacttggttaacactggatggaatggttccggcaaacgtatctctatcaaagatactcgtggtatcatcgatgctatccttgatggttctattgacaaagctcctactaaggttattcctttcttcgactttgttgttcctacagaacttccgggtgttgatccgaagatccttgacccacgcgacacttacgaatgtgcttgccaatgggaagaaaaagctaaagatttggctggacgtttcatcaagaacttcgctaaatttactggtaacgaagctggtaaggctttggttgctgctggtccgaaactctaattggagaatcagatataatatggaaggcggttcgatttcgaaccgccttttttgtttatgcctgtgcctttctatgagaataaatgctgtttgtttaaaacttttccctatatttgccaaaacaggagtactaacctttaaaggcggttatggtatatctagctactgacaaacagacctatgcggatctaagcattacagagactgctaataatgagcaatttcttttctctttgttttccaaaacagagacaaaagaaggaaaagcgctgatgttgaactggattatgtatccgctaagtgatttgggggaaatccgtaaaagacaggaggctattgtctgggatgctttgcccgaacttcttttgaatgaagaagagctggattttattgagtattacttggcttatcgtgaccagatacgggaagctcatattttactttcatgtgctactgttatcgaccgtctggtgcgatatgattcgacccgttatgtgatctgcagaggggtgaaattagtggttcatctcttgcattgtctgaaggaatgggcgacagaactaccacaggacgccccgcaactcatgaaagaatctgctgctatgattgataatattctccatggaagtgaattggaggaagtattggagcagacctctgatgaggaaaaacgactatctaactttgtcatagacaaattcgattatctgttccggtgtactcggttgttatctttgaaggaacttctgtctgttatatatctacttgatgtttgccgtacagctcaccgggtggcaaaagagaagagcttctgttgtatgccggtaatggtaccgacaatggacttctcggtggagggagtcgttcatccttttgtgaaagatgcgcagccaaaccgttggcagatgtcccggggaaatatatgcatttttacaggctctaatatggcgggaaagtcaacaactttaaaggcattgaccttggctgtctggttggcacattgcggtttgcctgttcctgtgaaatcaatgatttgtcctctttacgaggggatttatacctctattaatctgccggattctttgcgggacggacgaagtcattttatggcggaagtactccgtattaaagaagtgatgcaaaaagctgtgaccggaaaacgctgtttggtggtattagatgagatgtttcgcgggacgaatgctaaagatgcgtttcaagcctccgttgccgtcaatgaattactgaaaagcttctctcattgtcatttcttgatatcgacacatattttggaatatgcgaaagcctttgaaaaggattcttcctgttgcttttattatatggaagcagaaattattgatgatgcgtttgtctgtcctcatcggttgttgtcagggatttcagaggccagagtcgggtattgggtcgtgaaaaaaatactgtcggatggtttgatgtaattttacctcattatagaggttgttgagattctgttttatttttattagatatatattttgactacttttgtacagactataaatgggttattaatcttaaataacgacgcgacgaccatgaagaatttttatttccttcttattagttccctattccttacctccgggctttatgcgggagaaacagattatactcaaggactttccatctggtttgatactccgaatactttgcagggatatgctgcctggtatggcggaagaccggatttgtggaaagatgaaaataaaccggtaacagcaggaagcggacataatctggatgccagttgggagtcacagtcattgcctattggtaacggtagcctcggcgcaaatattatgggatcggtagaagccgaacgtatcactttcaatgaaaaaacgctttggcgcggtggtccgaacacagcgaaaggtgtggactattattggaatgtcaataaacaatcggcccatcttttagatgaaatacgcaaagcatttacagagggagatcagaaaaaggctgaaatgctaacgcgacagaacttcaatagtgaagtttcgtatgaagctgacggagaaaatcctttccgtttcggtagctttactacaatgggagagttttatgtagaaaccggactgaatatgataggaatgagcgattataagcgcattctttctttggattcggctatggcagtcgtacaattcaaaaaggatcgtgtggcttatcaacgcaatttttttatctcttaccccgccaatgtaatggtggtacgtttcagcgcggatcaatcggggaaacaaaatctggttttcagttatgcgcccaatcccctgtctaccggcagcatggtttctgatggaaataaaggactggtttacacagcttctttggataataatggaatgaagtatgttgtgtgcatccaggcagaaacaaaaggaggaacactgtctaatgcagatggaaagttgacagtgaaggatgcagacgaagttgtattttatatcacagcggacactgactataagattaactttgatccggatttcaaagatccgaaaacatatataggcgttaatcccgaagaaacgacaaagcagtggatgaataatgcagtggcgcagggatatacagctttattcaatcaacattataatgattatgctactctgttcaaccgggttcggctgaatctgaacccagcggtgaaaggagtgaatctgcctacttcccaacgtctgaaaaattatcggaaaggacagccggattattatctgggagagttgtattatcaatttggacgttatcttctgattgccagttcccgtccgggcaatatgcctgctaatctacaggggatttggcacaataatgtcgatggaccgtggcgtgtggattatcataataacatcaatatccagatgaattattggcctgcttgttctaccaacttgaatgagtgcgtgcttccgttgattgactttatccgtacactggtgaaaccgggggagaagactgcacaagcttatttcggagcaagaggatggacggcatctatctccggcaatattttcggctttaccactccgttggaaagtcgggatatgtcgtggaacttcaatccgatggcaggtccctggctggctactcatatatgggagtattacgactatacaagagacttgaaatttctgaaagaaaccggctatgaactaattaagagtagtgcggattttgcagtcgattacctgtggcataagccggatggaacctatacggctgctccgtccacttcgcccgagcatggtcctatcgatcagggagctacttttgtgcatgccgtagtgcgtgaaattctgatggatgcgattgaagcaagcaaagtgttgggtgtagataagaaaggacgtaagcaatgggagcatgtgcttgccaatctcgttccctatcaaataggtcgttatggtcagttgatggaatggtcggtggatattgatgatccgaaagatgaacatcgtcatgtgaatcatttgttcggcctgcatccgggacatactgtttctcccgtcactactcccgaactggcgaaagctgctaaagtggtattggtgcatcgtggtgatggtgctaccggttggagtatgggttggaagttgaatcagtgggcgcgtttgcaggatggtaatcatgcttatactttattcggcaatttattgaagaacggaaccatggataatttgtgggatacgcatccgcctttccaaattgatgggaactttggtgggacagcgggaatcaccgaaatgctgctccaaagtcacatgggctttattcaattattaccggctttgccggatgcatggaaagacggttctatcagtggtatttgtgcaaaaggaaattttgaggtggatgtgatctgggagaatcatcaattgaaagaagctgttgtacgctctaatgcaggaggcgactgtgtcataaagtatgcggatcagactatctcctttaaaactgtgaaaggacgcagttatcagattggatatgatgcaactaaagggctcattaaaaaataaacacaaaatgtcggaaaattagaaagaaaggatggtactggagtatttaaaattattcgtgacatttgcgaagattggaatgtttactattggtggcggttatgccatgattccgttgattgaacgggagattgttaacaagcaatggatgaataaggaagaatttatggagatgtttgctttgacgcagtcgcttccgggtgtgtttgctgtgaatatttctatttttgtaggatataagttgtataaggtgggtggtagcctggtgtgtgcattggctacgattcttccctctttcgttatcatgatgctgatagccatgttttttgcacagtttcaggataatgaagtgatgattcgtatctttaatggaatacgtcctgccgtggtagcattgattctgtttccttgcatttctgctgttagagctttgaaactgaagtattttcagttggttgctcctgccatagctaccgtgttgatctggcagttcggcttatcacctatttatattgtggtggccggaattatagggggattggtatatacattatggttgaaagaaaaaatagcgaataaacaggtatgatatattggcaattactttgggtgtatcttaaaataggtatgttcggttttgggggtggatatgcaatgctttccctgattcaacatgaaatagtggatcttcatcattggctgactcctcaacagtttacggatgtggtcgcaatttcgcagatgactccgggaccgattggcataaatagtgctacttacgtaggttatgcggtaacacaaagtgtttggggagctgtgttggccactgtagccgtttgcttgccttcttttattttggtgttgctcatttcttatttctttgcgaagtgtaaggataataagtatattaaagcggctatgtctggactgcttcctatgtcggtcgcgctgattgcttcggctgcattacttatgatgaatagagagaattttatagactataaaagtatcggtattttcgcagccgcctttttggttacatggaaatggaatcttcatcctattctgttgatttgtctggcgggtgtggtaggattactgttgtattagtaatacttatgggaaaaagaggaggttgtgtcaaaacgttggcacaacctcttttatattttacagttctgctaactaactcgcaatgaattagttgccttaaattttattattttaggaatatccctacttatataaaaaaggaagaataacaatcagtccggaaaaagactgggaggaacagaatgacgaccacaaaaaacaagaaatagagaaaatgtataaaaggaatatgagaataagaaaaaagtctatgagaaatacactattttcagcataaaaagctggtaatattatgagaaatgccgttttgaaaagtatttctcataatatatctatttgattatctttcgtttatcgaaaaacaatgagaatatgagaaatgcaagtgaaaaataggcgacaggagaaagtgtgcgtaagtaaactgaattcagcatttttttaagaaagagcaaaaaggaaaagagcaaaaagaaagagataaatccaggaatccgattggatccatataccgtatacctaacgagcaaaattcctcttcagttgttattcatacataaacatattctatacaataaaaataatatcatggagaaaaatatttttcagttaaataatgagcagctcaaagaaattgctcgctcatttaaagcgaaagtagaagaaggtttgaacactgaaaatgcagagatacaatgcattcccactttcatcactccgaaagcaagtggtatcaatggcaaatcattagtactcgacttgggaggaacgaattaccgggtagcaatcgttgacttcagcaaaatgcctcccaccattcatcctaacaatggttggaaaaaggacatgtcgattatgaaaactcccggttatacccgagaggagttgttcaaagaaatggcagatatgataaccggaataaaacgggaaaaagagatgccaattggatattgtttttcttatccgacagagtccgtcccaggtggagatgccaaactgctacgttggaccaaaggagttgatataaaagagatgatcggagaagttgttggaaaacctttgctcgactatctgaatgaaagaaataaaatcaagtttacgaacataaaagtgctcaatgacactgttgccagtttatttgccggacttaccgacagtagttacgatgcgtatataggtctgattgtaggaacaggcaccaatatggcaacttttattccggctgacaaaattaaaaaattaaatccgtcacataaagtagatggattgattcccgtcaatctggaatccggcaattttcatccgccgttcctcactgcagtagataatacaatggatggaatctccgggaatccgggaaaacaacgtttcgaaaaagctgtatccggtatgtacctgggagatattctaaaagcaactttcccattggaggagttcgaagaaaagtttgatgcacaaaagctcacctctattatgaactatcccgatatttataaggaggtgtatgtagaagtagcacagtggatatatagtagatcagcacagttagttgcagcttcactgacagggcttatcatgttgttgaagtcatacaacaagaatatacgaaaaatttgcctggttgcagaaggcagccttttttggagcaagaacagaaaagacaagaactataacatgattgtcatggaaaaattacgggagcttttcagtttgtttggtttggaagatgtagaggttgatatcaaaagcatgaataatgccaatttgatagggacaggtattgcggctttatcctgacacctccctgcctatcatcgtcattacagggtgatcctcccaatcgacttgcttataagaatctgacaggaatgtgccagaactctctttttaatgtaatagccctcgctacagatagttgtaacgagggttattcttcgtttataaagatttgcacgcacccttatctaacctattgcaaatatatcaaatctatttcaagatttaatagacaatgtagtgtgtaaagtggttgtttacttaatcttcaaagcaaacccacctccgggtgccaaatgaatcttcaacttactgtcattttttatccggatggattcacatttataatcacgcccgatccggtgagcatttgctccgtctttaaacaatgtagcatcatacgtcttaccacccaggaaagagcaatccacttcgatgtcacgtgccgtccaatcggtgattccacctacataccagacatttccactccggcgtgctgttacgatatactctcccatcttaccatcaagcacgatactttcatcccacactgtcggaacatcagcaataaatcctgttgattccggttcgcgcatatagttgctcggcgtatcacacaacatattaaaaggagattcgaatacaacgtacagagcaagttgacgacaacgggttccctgactcatcggttccgaattgcaagggtaatagttacctttcgaagcattgcgcatcgccccttgcgtgtaatccatcgggccggatacttgacgtgtgaaaggaagcatcacgtcatacttcacctgatcgactgaagccggactccatttcatctgttccagaccattgacgccttcaaaattcaacacattcggataggtacgattcataccggccggcttgtgcgttccgtgcaggtcgagaatcagtttgtatttagcacacatttcggcagcccgataattgaaggcagtcataagctgatcgtcacgatccataaaatcgaccttgaaaccttttacacccatgtcggcataatgacggcaaacgttctccatatcacggtcaaaagcataataaccggcccaaagaatgatgcccacatttttggaagctgcataatctaccaattctttcagattaatctctttcaccacttgcatcaaatccgcttgcaggttcactgcccagccttcgtcaagtatcacatattctataccgtttgccgaagcgaaatcaatgtaggctttataagtaggattatttactccggtcacaaaatcaaccccatccagattccagtcgttccaccaatcccatgccactttgccgggtttgatccatgaaagatccgtcagacgggaaggggcagccaacaaatagctcaagttacttgctgccaaatccttatcggaagtggtaacaatgctcatacgccacgggaaatcccggggtttatctactttggcaatgtaggcttcatgctctttcaccaacatctgaagttgattgtgtccgccctgcaccatcttcttgggatagggagcaaaactacctgtcaaccgattttctccttcagcagcagacaaataaagaccggggtaattctccaaattggattctgtgatacaaactttaacacctttgccggcatccacaactaatggcaaaaacatcaaacgttttttattcagtttcgacaatggatcggtcgtataagtattctcgaaagaattgaaatattgggagtcataatcaccgtcctttcctgtttttacatatggcacagaagctatcatatcggatggaaaatgataatccaccgtttcatccaccacgttgaaaggtttcttcgaacggctgacaaaacgataagcaatgccatcatcgtatgcacgaaactctacattccagtcttttttaaaccggagagtcaactcattataatggtctcttaattcaccggcacgatagaaaggagaaggaatcacctgatctactttttttccggaagtgccggacaacttcgctttctctccccagacttctccgttatccaatgtcatcgaaatcggagaaggagcaagaatctgccgtccgctacagtagatgtcataagtcagcttatcaccaacggtaatggttgtttgaagtttcccatccggagagtttaaggtaaactgcttttgtgcctgtaccgtaagcgtacatgcgacaacacataagaataataaaatcttcagttttttcatggttttaattatttatcatttagcaataaaacatttcgtctttacatcccggctatttgtacctatcattatttcaaattctcccggttcataaatatagtgcagttctgaattatagaatttcagatcgtcttccgtgatgacaaacttcacatcacagctttctccactcttcaggaagatgcgttcaaaccccttcagttccttcaccggacgggcaacctccgcataaatatcacgaagatacagttgaaccgtctcgtagccgtcgtagtttcctttgttggttacagtgacagatgccgtcagttcaccattcttaggcagtgtttccgaactgatttgtaaatctccataaacaaaatccgtataactcaaaccgaagccgaacggataaagaggttcattactctcgtccagataattgctggcataacgattgaatacacgattgtcgggatcaggacgacctgtgttcagatgattgtagaatagcggcagttgtcctactgaacgcgggaaagtagttgtcagtttgccgcttggagttactttaccgaataatacatcagcaaccgcatctcccgtttcactaccgccaaaccagacattcaatatggaatgaacatttgcatcttcccaattcagtaccagaggacgacctgtgaacagaagcagtacgacaggtttacccgtctttagcaaagctttcaacaaattctgttgagcatcggggatttcaagattggtacgtgaagccgattcaccgctcatttccgcacattcacccaaagcggcaacaataacgtctgcacgtgaagccacacgtaaagcctcatccaacagtttccggttatcttcgtgttcaagcgggcgaatacccgcagccgctttttccatttccgcatcctcatacacgttactgccttttgcatatagtatttcagctttgtcacccgctgccgaacggattccttccaacaatgttccgtgacgggaagcagtgcacgccatgctccacataccgcacatgttgttacgggcgtctgccatcggaccgactaaggcaatcttgccttttaagcctaagggaagcagatgattttcattttttagcagaacaaatgtttcagatgcgattgcacgtgcagcagaacgatgttcggccgtataaagttgctccttgacacgcaaggtatcgccatatttatacggattagagaacagtcccaatttatatttggcttccagcacacggcgacaggctgtattaatctgatcttccattattttcccttctttcagcgattcctccaacgtattcaggaaaccacaagaaaccatatccatatccgttccggcctttaaggctcgcacggaggcttctttcaagggagcaatgccatgagaagccatttctgctattgaattatagtctgttacgagtaatccaccgaagctccattcatcccggagcagatcggtcagcaaccatttgttggctgtggcgggaataccgtcaatgatattaaaagaactcatgacgctgcctacaccagcatcaacggcagctttgtaaggagccaggtattcattatacatacgcaggcggctcatatccaccgtattgtaatcacgtcctgattcggacgctccataaagtgcgaagtgtttcacacaggcaaggatttcatcatttccttgcaggctgtttccctgataaccacgcacatatgctctggccatcaaggagcccaagtaaggatcttctccactcccttccgcaatacgtccccaacgggcatcccgacagatatcaaccatcggactgaatgtccagttgatgccatccgcactggcttcaatggcagagatacgtgccatgcgttcgatggccagcgtgtcccaactacaggaaagcgccaatgggatcgggaaaatcgtttcataaccgtgaatgacgtccgcacccacaagcaaaggtattttcaaccgactttcctccactgcaagacgttgcagagcgttgattctccggacacctttcacattgaagaagccgccgatctcctgcttacggatcatatcgctcaactctccattcattaccgtacctgttaccatgtcgccgcccgaaggtagattcagttgaccgagtttctcatggagagtcattttccccataagctccgtcacaaaacgatccatctctgccgcctcatcgcggctgacatccgaacatgagcaccctaataatatgccaagcaagacataacacaatctggcttttttcactgtaatcatttcgcaatatataaaaaaatagtcaaagattatcattttaataaagaaaggccggtacttctacatttccgacctttctatttctgtataaaaattcctactctatagttttgtaacggtacacgtatttgtattcatatcccacttcagatgatatactccatattggctatctatgttattaattgtagctccaaaattaacatcattccctccgtcagcatcatatccccatgcacgtccaaaggagccatctgttgaaataatatttacttcggaagatttgatagcataataccaggctccagtcacatgttttccctgatagaaagccacacatccccaattagcgtgaaaatagaaggttgtttcaaagattccgtcacctgttttagcacaacaaagatattgcccgggagtagcaaatccccatccggtatcatccacactcagataactccatatactaccgtctgttttgggatgcccgaaaccatttccggtaagccacatcgcatccggatagtttgtcttgtctgttctttctacataaataaattctctatccgagcgataactgatgcgataagttccactgacagctctaaacttatattgtccgtcgacccgttcgaagaactccggctgaagcatatatcccaaataggagaatccttcaaacgtaactgtttgcccctgtgtcaaagcgagttccacttccaataaatcagaggctccgtttggctgcatcagtttaccattcactttaaattcaagtgatttaacgtcgccttcgttcatcttattgactgctgcaataacctttttattgatgtcgatacgaagacgatacactccgggagtaaaatccttaccaggaataaggtcaccagtaaaatgtccattgcctatgctactcaaatttgaaacctgataatgcttatccagcagattagccggtaacggatcgagtatctgggttccaatgcctgtaccccagtccgcacgcttcttaaagaataacagatgaaaatcattatccagaaataaggttgtttcgaaaataccatcccccactttcacacactgataggagtcacctgtattgaattgccaaccatgagctgttacgctttcagcagccggatggccgtatccgcttccacaagtccacagagcatcgggaaattccgactggatattttcaacataaatcaatctattacccggatcatagtatagattatattctccactcattccccggaaaacggcttggtcttcagtagcattttcaaagaaatcaggttgaatcattgcgctgatatcaccgaaattctcaaaactcagtacatttcctttttgtaaattcagcttcactcccagaaaagaagggactccgggcagaatacccatttcctgaccattaacaatgaagttcatgtcagaagactacccactttgcggttgcatggagaaggtgcgagtacccatatctatcgtcaaacgatagatacctgattggaataacggccccgccacaaaatcaccggaagatagtccctgaaccaatgtcggcttatctaaagtaaggtcttgagcccaaatctcaatctctggatgagtgccccagccatgatgtctgaaaagtttaaaaccaaaattctctgccagatagattgatatttcaaacacattgtctgacacacggcagcaagtcatcccattatcgggtgtatccagattccatgtagcagaaatgactctgccagcaccgggatgtcccagattagcgcctatcaggtagagagcgtcgggatattctttctccggttgttctacataaagcaattcattagtcgcatcatagattaaatcatattccccggtttcgcctttaaaacgtgctttcgtatccgacataaattcccagaactggggttgtaaagcaaactctaacgcgtcgaatcctgtaaaatcgacttccgccgcctttgtcaaatgaagttttttccctacataatgagtataatatgtctcggtcattttttctccggccactgtgaccgggtcttgtgttttccattcaggccagttatcatatttctccacactgtccgtacaggatacaacgaagactgaaataagtaataatattacaatataatagttcttcataatatatttgtcctttttatttcttgtaagcctttaaaatagcttgataaaccttctcattcactcgaacaatgcatccgtgacgggcatcgggaccttgaaaataacattcagtccaaggaccgtctatcgaagaagctttaaacatgtcatattgcttcggatagcgctctgcatagagaaaaaatccttcaccatctactgtaggaacgagtataggggcctcgtgccacacacttaatgaagtaatcggagctcccggattggtgtatggtcctgtcaatgtcttcgactttgccatacgaatcgttttagctacttccggagcatcttccggccagcgttcatctttgatgagagcacaatactcatcacccactttacgaataatcacatcaatggttgccatgtcttcgtcactacccgtaaaattgaacaaatgtttcgggtcggtgaaagtcttgaaatccgatgtcaaaatataaaaggtacgtttcgtcttccattctgatggctccccgtcattgcctgttttaccggcatgccaggtaatgatatattgtccactagtctcgtcataaaacatttttggagctccgtaataggtttcttcatttttataccccaaatctgatattttattaaatatagactttttcaatttatcactcttccagattaccagatcagaagatgaccacaatataggtatccccgtgttaggctgtacaccaatcatataaaagacaccgtctttcccctggcaaatatccggatggccgcaatagtccggcaacacgattcgctttttattcaatgtttcccaatgaaacgcatcacgtgacactgaataaaataaacgggcataattttcatcagtcatatgagcaaacaagtatccgccatcagtagctaccatcggttctttattttcttgtatcgtatcgtccgaacatccccatccggcaaatatcattagcatacatattagacaattcatatatttcatgttatttgttatttaattgaataaaaatcattttcttagattccaccagctgcatttttgtctgttttccaatctggtctttcatagttttggacgagattcttgccattctccgctgcttggtctacggcataattgggtagaggcatatactgcttagtaggtacagtacctttcattccggctgtctcacgtgcataacgattgaaacgaatcaaatcaatcttacgacatccttcataaaatagttcgtgtccacgctctttcagtatggcagtcagaaatgcatctgcagatgatatatcgtcagatgataaattacctagtccggcacgattacgtacctcattcactgctgatatcgcacttgctgtgggtgctgctttcgataggcgaacttccgcctcggcatacatcagcaacacatccgcccaccgagccaaaggaatatccgttccctgaaaagtgccaggcgtttccactggaaatttattgcagataaacccatcccatttcaccccaatatcattttttgtcacctttattccatcttttgtccagtattctgtaaggatggcctctttgcgtaagtcgtccttttcaaaagtgttatagaacttaggagctacattgtaaaaagcattccaaccgccattttgtggatagaaaggagtacggtttcctgtcgggtccattgcagatgcttcattaggaaccaccagccaagaaagaacattcgcatttccgttcttgggatttccatcagcatttggatcacaactcactgccattataatttcgttattaaatttattggcatttttaaacaggtctgtatatggattgcttcccgatttaaacaaggaatattttcctttcaaagcctcatacatatccaacgctttttgatagtaaccatccatatatcctccttcattcaggcaatgacgcatcagacagaaacgagcgtaatcacgagtataccgtcccttctccaacgtagtttccggagcattattggcagcaaaatccaaatcgtctgtgatccattcgcacatttcggtcaatgtggggcgaaccgtatttcccaatgcttcttcattaaacacatcctccggattgattatcaccggcaccggaccataaatatgcattaagtagtaaagcatcatcccccggcacagacgggcttctcccaacagactattctttttttctttagacagtacgtcttcagaagctttttccaacgtaccaataatctctgtaaaacgagttacctctgccgttttaggaaaatgattcaggttattggcatcgtctacccaacctctccaataataataacaattttcataattagcctgagaaaggcggagccattcatcactacatttcactacggccggtgccattatatccgacgtagagtcgaacatacgaatattgcccccggtagcgatatagaaaccatgctgtcctgtgccactgttgatctgataggtaaataccgatgtgaacggaatataacaagtcatcatataagaaacatattcatcttctgtggacggatattttccctgtatgagatcgccatagatatgtgcatcgaaattattctcacaacttccaaacagaagaaataaggaagacagtattggaaataatattttctttttcatcatatttctacattttatatcaattagaatgaaattttcgcaccaaaagaataaactctcaattgaggatattgtccgtgaccaagattaccagcggctgttgtaatttccggatcgtcgccttcgaacttggtcaatgtgaatggattctggaaatcgacaaagagacgaatagtctgcacatttcccttcaggaaagctagtttccttgtatcccagttatatcccagcgttatgtttctaactctcaaaaacgaggctttttcccaaaatgtattgataggagcgttttcgggcagtgctacggatttactggaagcaattcccgggactgtgccattcggattggtctgtgagttccaaatagcataggcgtaatctgtaggattgctggccaatgtaccgcttgctaaattggcagcggaacaattactggcgtgggttgaattaaatttcttcacgcccaactgtccatacatatagatgtccaaatcgaaattcttataagtaaaagtattgccaaaaccataatagactttaggcaacgtattgtccatataaatatcatcgatatctattttgccatctccattgcggtcatcaataataggatatccgggcagttgtgcttcacgaggcaatgagcgttgagaatcgggcatgttgcttctatcctcattgatgacaccaaccgtcttgtaatagtagtaagcactcatcggctcattctcccgtttctggtatttcttataatcgaaattcggcatccgttcgatccaatatgcattataatgagacaatgccagtgaagaggtccatttaaaattcggtgtctggatattcaaggtgtttaaggataattccacacctgtccgtttataatgtccgccatttatagggcgataaccgtacatattcaataaagaggtaggagctgtgcccaacaggttagtcacatcattccgaaagaaatcaaggcttccccatattttatctttcaagattgaaaaatccaatcctatgtttttcatcgctgtcttttgccaggtcacatccgagtagttggcactttgcaatgcataaggtacataagtaacaccactattggagaacttaacgtcttcacgggagataccgataataccatataaggatgttccaagattgtcgctacccgtcacaccataactggcacgaacttttaatagattcaaccaggaaaggtgttgcataaacgattcattagacattttccaggctaccgaggcagaagggaaaagcgaatattttttatccgggaagaacttatctgttccatcccgccgtaaagtgcccgttaatacataacggtccaacacatcaaaagaggcacgaaggaattgagaacgtttctcattttcatatttatatgaagtaggagagaaaggcccatccgcagcagccagattgctatcattaatcatatcatttgcattttggtaagagacggtcatcccggttcccttgtctaaatagcgtcccatacctgccacagcatttacgtctatcatattccagaacttatggcggaaagaaagagtgccttccattgtttcatactgccgttcattatatccaagactccctcttgatttacgaacaagtccccaataaacgtctttaggaatataggcagagcgtttaccattttctttattcacgccatataacaacttagccgacaacatatctttgataatatcaatgtcaagagcaaagttcacatagtagctactttgtttagatccatcacggatttgcaatgcagccagtgggttcggttccctgccgaatatggtatattctcccatattatcatatatagcgagataaggagcataattcatcgctgtataaagagatcccgctgccgagtttccttgattaccggtatctcctcctactgtagaattactgtatttattatgattcaaattcgctatggtcgttaacttcaagaagctgaacaactgtgcggaaatattagtccgcaaagagtatcgctgcatcccggcattacgaaccactccatcttcgtcgtaatagtttaatcctaaataataacggagtgtttttgaaccgccactaatagtcaagttctgattattgacttgtcctgtcttcaacacataactcaaccagtcggttgtagttgcattcgctatttgctcggatgtgaataccggagtccatttaccgtcatatcccacatttccataaggatattgctcattaataaacagatagttttcttttccgaataaattgaccatattcatgtattcttgtgaattcaagcgattcatgccgtaagaataacgcttctgaacagaatagctcccttcataagtaatgcgtggctttccttctacaccttttttggttgtaatcaggataacaccatcagccgcaccaataccataaatagctgcagaagcatctttcagtacttcaatagattctatatcgctaggattcagacctgccaaagctgcacgcttaacgccatccggcaatccggtttcaccactcccgacttctaaagaagaatttggcatcactactccatccacaacataaataggatttccaccaccacgaatagaaatattaatttcacctccgggttgagtgctatttaccgtagcctgtaatcctgccgcacgtcccaataacatactggctacactgctattggcagctttcgatattttttcagtctttacggttgcaatagctgtggttaggtttttgcgggaggtggtaccgtatccaactactaccacttcatccagcacctgctgatcttcgattaaggtaatcgctaaagttgtccggtcgcctactttcacttcttgtggctgataaccgatataggaaacttccaatattgctcccggtgatacttccaaagtaaaattcgcatccaaatcggtcgcagttccattcacatctcccttttcctttacagtagcaccgataataggctcaccattcagatcattcaccacacctgtgattttccgcttcttatcgcctttcacaactttcggacggggttgtcctttttgaacaataatgttctttcctttcacttcataaacaacgttttgtccgtacaaaatctgatcgatagcctcattcaactgctctgcctttacactgacaattttctttgtatccagatctcccactttatatacgaaggaatatccgcttttattcttcagttgcgtcattgcttctttcactgaaacattattcattttcaatgaaacggcctgggctagcattgctatgttaaggcaaaagagagccacgaccattaatatggccttcttcctgtaattcataaaataaacaaattatttaattaaaacttgaataactcgttttaaaagagatgtattttgctaactttgcaatatctcttttgaaaacatgttcactcttgagggttgttgaaagaagagatcaggagccggaagatgttcgagatcttccggttttattttttctctccttaataaactaaaggctattctgtattatattcctccttcatattcttcaatttctaaggttaaacaatcatagtattataaatctctggtaaccggttaatagatagttatattgcgttcttcaatcttatattgtattttctccgtagatgccaatgcttccagtacttcctgaatactttgttcacggcgaacaaaattaccgtagaaccggaaggtatttaaagaatcattggctatgcggatagttacattgtagctacgttccaattctttcacgatgtccggcaaaagttcttcatcaaaaaacaaatagccgcctgtccattgtgaggcattggaggctgtgactgtttctactgtcatcagtccgttcgttttgtttaatatcgctctttcgtcaggggcaagaactgcttctttctcttttttcagtaaattattcagttctacttttccttccaataaagatactacgacttcatgatcttccggataatcacggaaattaaatttagttcccagtacttgcaattgcaaatctttagtctttacaaagaaaggaagcttttcatttctccggacttcaaaatatccctcaccttccagttcgatcatacggttatctaccccgaaaccttgtgaataagtcattcgtgaaccggcattcagccataccaatgtaccgtccggcaaatagagtttcgtcctcgaccctaaaggagcttctacggagatatcggcaaatgtgtcttttacatccacacctccctgccaataagagaaacagccgactgcaagtatgactgtgacaatcgctgcataacgccacaaagccgacagacggaatccccgacgggaagttttctccacttctttctgactttcgatacgattcttaaatgtatggaaggccttatctttattgtatttcaacgcagcttcacggctcacggcagaaaaccagacttcccgctgctgaataaagtaattttcattttcagttgatgcagcgatccatgctttcagctcggctaaagcacttttgtccaaaccttctgtgagataggtgacgatcaattcatccatatgtttcttttcttcttccatatttctgcgttctataaaggagacagtagatttttaattgagggtagtcagaaaatgactttttttcgtttttatccgaaaaaaaataaaagcagagtaatcaggtatttacttagattcgtttgtaaagatgctaatgcattctttatatgatatttaaccgtattgacagagatgcctaactcttgagaaatttcttcgtatgattttccttcaaaacgacttttatcgaatacgcgacgacattcgttcggcaatttatctatggctttatatatttcttcttccagttcgcgctccaacaatgtacctaacggatgcgaatcggacaccatgattttatcatctgttatctcatcgggcataagacatgagaatgagatctcccgcttttcccattctgaattaagatagttgatacaacgattacggacagctctcaacaaatagctacggatagaaacggaaatctccagtgtttcacgaatctcccataaatgaaaaatggtatctccgacaatggtttccgccagaaactggtcttttacatagccattggcaatatggcacagtagggcatagtgacggtcatagatgtattgataggcgtcttcgttgcctatcttcaactgctctactattaaagtttcagtgtgctccatgaatgtattagtcgagttaatggcacaaatttagagaaatattcgaattaaaagcaaaattaataagaaaaccctccaaagagtttcttctccggagggtttaacatatcatttaatatgattcgtttatcaatacagtagttacactttcctttcctaaataaaatgcctttgcttttatcagtggagcattgcatgctatcggagtttgccattctacagaactttccgtaggttcactaccatcggttgtgtaccggattaccgcattgggaatggcagtattagccagtaataatccatcccttatcataataccgggaggagacacacggaaatttattcctcgctttgccaaacgtggcaattcataatctacaataccagcattatacttacgcttagcatccatatatattttgccatccggcgataatgcccacgatggttgagcattccaagcacgttctgccaatccgaagacttttgggaagagataatattctatctgttcaagactgcggattgtctctgaccagatttgcccggacagacctttgatattctgatagccttccttcgttaagggctgtttaccgtttgaggctgttttcacatcaacagattcacctttcaaattccgccgcaaagacttataaatatcaaaaggcaacatatcaaacgtcacatattcatctacataaccgccccaacgtaatcccggttcttccacatgatagcaatatgccatatcaagataaaagttacccacattacaaagtataatcggatagcccgcattggctaacttatacgggacttcatctccaccctgttccggaatggtattccagcaataatttagcaccttactgtttctgaaatgttcgttcacggtattatccggattcataactatgtcttgccatccgactgcctgtatgctacgtttgtccaacatttccaatatttgttccagaaaataatctttcaaatcccgtatattggtcagttcgttctcttgcataaaagtacggcagatagaagaaccttcccaaataccttccggtacttcatctccccccacatggaaagctgtcagttctactcctgcatcctgatacatccgtacaatttcatcaatcactttttcaagaaaatgataagtggaaggcatggcaacattgataacattatcagtgaaattttgtgccgacagatattgggaagtatccgcaaaatcaatcaaaagatattcttccgctttcggccgatccgtatctatgtatttttgataacgggcattcatggctttaatcgctgctcgggaatgtccgggaatgtctatttcaggaataattctgatatgtctttctttcgcatatttcagaatatccatgaagtcacttcgtgaataatatccattggccaatgaagtagtatctgtctcattccatccccaagcatacgcaggataaagacatgtctgttcatctgtagtatgtcctctacgagaagcgatttctgtcaattcctccaatccgggtatttccacacgccaagcctcatcgtcactcaaatgcaaatgtagtacattcatcttatagaatgacaatatatcgatcaatttcagcagatccgctttctttgtaaagttacgggctacatccaacataattccccgatgctccatgtccggataatcggtaatatgaagattaggaagcggagcagaagttagttccatgttatctaataaggcaagcaatgtttgacaagcattaaatatgccatgtgcatcattagctttcagagtcaaccggttattctttatcacgatttcgtaatactcatcaggatattgactgggaacaggaacctccattttcttcaattcaatgattgtttgttcatcctcatcagaaacgctgcatcttaataatgaagtcaattgacttttcaataaaagagcttcctctttaaatgtatcatcaaacttcaaacaaaccttttgagagaaagaagaaacaccgcccgtcttttccacttttttaggagcaggaaaaagagaaagcatatcacaatctaccggtttactgaaatcatcattctgcttatagaaataatttccacctgcatagggaaaactattcttcgaacgaacccattgagcattgggcgtaaacagtccgatctcaatcggaatattttgcggctgcaacattttcccattttcatcggtagctacaatataagccccttcaggaaccgaagatacattaatcacatttccttcgctcaatatggtaaaagtgattgtttcacccggtgccaatgcctgatagtgttcagtaggatacatcttataataagtcgaaccaatacattctatttccaacggggcattaataggttgctgataataaattggtgtctgattaaaatagatcacccaattatcagccaaggatttattcccgttattcgttaaacagaatgtattcttaaaatatctggcttccacactatctttttccagtttccatgttaaagagagctgtgaggaaaggggctgtttaccagccccacaaccaaacaagcatatccccaacatcattatccatatattcctcatagttatcataagggaattatttagttaatgaacgaatacattccacttcttctgttgaataaggtgtcccatcgctacggaaaatatcatgaaaccacaaggaaggttcagttacatcaggcaacggagtatcccatgcaaagatcgtatttgtttttccggctacaagtccccagtttattgcaccgatattttctttctttagcattggcataatatcttggaaagtactattttgagtacgtgccatatattccgtgcaaatcatcggacggccatattgcttcaatgtgtcaatgagccgttgatgcgaatccagaccttcatacgtatgataggttatcacatccgagttttccaactgaaacttattcagattagtcaaactcatatcccagactccggccgacaagggttgcgacgggttaactgttcgtccccacgtaaatatattctgcaataacggcagacttctttcaccgtatctatatccgcccgaaccaccgggctcattatataaatcccacaacacaattctcttatcatccttaaaagtggtaagaatgtctttcacataattctccaagaccggaagtatcactgccggatcacctttataatacaaatctcccggatcacgcgcccatcccgaattgtgtactcccggctgtggttccggctgtttaccagcctgatatacaggattccagcaatcatccaggaagacgaagatggtagagatatgatgcttgtcggcaatagtaaggtattcattaatacgtttcttaaaaccttccttatccgttttccaaactagatggtgcaaatatacacgcatacagttcattccgatatcttctgcccagcctagttcacggtcaatagtcaccggatcaaaagtatcagcctgccacatctccaattggttgattgccgtgctcggaataaaatcacacccacgaagccatccccattgctgataccattcattagcctgctctttcgtccagacttcacgaacagagactgttttctgactgcaggcaattaacataatgctaataaaaaatgagagtaatatctttttcataatcgaattttactttatctaattagaaacctttattcattttctccatgtaaatataaccatatcccccggttcaaccgctatcgtagaaccatccggacttacagttgagccatccttcagcactctgctaacagaaccatccacatcaattgccagattcatcacattacgaaagtctttatttacaactacaagatattggttactacctttctccaagaaagagacaacagcaccggtatcactcgtagtcaatgattttataggagtcggcagacttcccaaagctgtcgttccttccggtatttcacttccggtatgagatactgaaattacttgtgctcccaagaatatacccgcaagttgttgtacttcctgattaacagtcttgaccaaattataaacttcggtcggttcgtcatgttgaagtccgcgataggtaaaatactggattgcctgcgcaccataagccaaatcactgaagacttgtaatctcaactcgggcaatgtcggtatcttataaaaatgagtttcatcaagcttgtgggaaagtgcaagtgcaaatgcccagaacggcttattattctctttagcagcagccgatatttcttccagattccgataccagtccggacggacaatgctgggagcaccatttatagatacaataggataattgtcaaacgaaataaatggaacaggaacttgttctataaacgactttatattttcagaataaagttctttcccccatgcccaattggggtataaatttatataacaaggatgatggctgtcgatggttttaatcttcttcaccaattcgcccaagcccggcaaatcattcacttccggttcatccttcaaatggtaggcatacaaagccggatgattcatcatcgcttttacgacctcttcggcagtaccaacagacaagaggtccttacaagaagttatcattttcactccggtcttctgtgcggcgtcaagcaccttcaatgttgtttccaaatcatcataccatcccagataaatattaatgccggatgctttcatcaccgggaatttctccagcgacttatctgcttccactccggtccatgctataatcggaaactctccatcagttgtaggaatataagaattaccctgcatgatctcaatttcctgtgtcttcactccgttaggcaccacacggaatacagctgtacgtccggttcctgtatttgcatttgcagtaattgtcacagttccgtttccactccctttggccggtgagatggtaacccaagactgatccgtctcgtttacaaatttccattccgtattagactttatcgaataaacctccgtaaaaccgtcattaccgatctgtaacttctccaaatttccggaaatagaaaaagaggctttctccgggtccatcgaacaggacatcaataccattggcaacattgaaaaaaagaatgcgaccagtaatttcttactatatgttttcattgatatatacataattctattaaatattaaattaaagactattaatcttgaccccctcttaattataaggagtcaatcgtatcacttctttggctttatcaatatgtatcgtataaagtccggctttaaaatcaggaccgggaatcagatcgccaggggcacttctcgtaatcaggttagcaggttcaaccgtatacagattcttcgtgtcctcctcttgtgcccaaccatatcctctaaagaacttaaatcccatagtctggtcgatatacacaactgcttcaaaagcacttgcacctaccttcttaaagaagaaccattggtgaggatatgcgaaatcccaagcaagtgtagccacataaggttcacgcgggaatccaactccagtaccaacaatatacatcacttccggataaaagacatcccgcggccgctccatatacataaaaccgtttgatgtattatatttcaaattataaagtaccgacggaccatcgaattttgctttgcttcctgaaacatctttaaagaattccggccggagcatgttagtgacatcactaccaaaacctataaaattaatcttggcactttccaccagctgaacatccaactggacatatcctcctcccacatcaaagaagcgggacttatcaatatcaatgctgtatgtcaaagtcttatcagtcagaaaactcaacatatcaaaagtgatattctccaatgtataactccctaccttaggagtcggaatcgatgtagctgcatcatcagtcacaatcgcgatcttatcgtctgaatatccccataccaaaccggaataatcaggtttattgtttattatcttttcggcaactttaaaatggtcgccaatccctgccaaatccgccgcactcgtccggaaactataatccgtttcattctgactctccttgtccatttcatacacatttcccaaatcatcaacaaggtataatttggaaggtgtttccggacgggttaccgccacacttgcggcctcatccaaagtcagggtcgattcattgccacctaaatcgtttacagcctttatagttaccacaggacgtccattctggaaaccggcaacaaaaggtaaagtagcttcctcttcaataaccgtagaacgcccactcaatcctttagacaaattcaagatttcggccccatccattgtcactaataattggaatgaaaccaaatcattatattcatcactgatctgtgcggtgaacttcactttatcaccagccgccacaaccgtttcaccattcacgccccgcaatacggcattttctattttaggttttgaaggtgtaggccactccggccattcacttggcttactaacatcatcttttgcacacgaaaggagcaataacgacgacatgaataatacatatatctttttcatttttctaaagatctctagtttaacaataatgaatgatgacattaattgcgagctgccgcaagatccgctttccatccctcacgttcaaatgtctgtaccaacacttttccataagattccgaagcttgttgaaccgcgtaattaggaataggcacatattgatgtgtaggagccactcctttgatcttcgctgtacgttgcgcatactgattaaaacggatgagatctattttacgcatcccttcatacaacatttcatgtcctctttccgtaagtaaagcatctaggaaggcttcaacattcgctgttgccgatgacggaagatctcccagtccggcacgcttacgcacctcattgaccgcagcaatagcatcagcggacggagctgcattgtttttacgtacttcggcttccgcatacatgagcaatacatctgcccaacgggctaacggtatatcagtcccctgaaaagccgtggccgtttcaaccgggaatttattaattataaatccgtcccatgtggttgtattccggtcaatccaagttccggcagtcgtataatatttggtaaggatcacttcacgacgtttatccaaaggatcatacgtatcccaaaatttcggagacacgttgaaggtttgtccccatccctgcccttgcaagtagaaaggagtcggatttccctgatcgtccactctggctgcattatcgggagtagcgagcatcatcagcgggttaaagttaccggacttattcgtaccgtccgccgtttcatcacagctgacagccataatcacttccgaattgaagttattggcatttttaaattgctcaatataaggattatcccctttcttgaaaagactataccgccccttcaactcattatacatatcaattgctttctgataataaccagacatataatagccttcattcaagcaatgccgcatgatgcatacacgtgcatagtctttattgtaacgtccctgttctggctgtgtatctgcaatatactgataagcataatcaaaatcagccataatccactccgtcatttgctgtaatgtcggacgtaccagattttccagctttgaaggattaatcagatcgtccggatcgacaatcaaaggaacaggaccatatacatgcaataaataatacatcatcaatccccgacaaagacgggcctcggcaataaactcccttttacgctcttcggagaccacttcggtagaagccttctccaaagttccaatcacattggtgaagtaggaaatctcacttactttcggaaaatgattcggcctttcatcacttaacgtaccactcgtataatagacacactgactgaaatcggctttggaaagaaagtagtatccgcctccccaaccattattccacacagccatttcatctgtcggataatcaaagaacttcagtacacctccggcagggatataccaaccgtgctgattaccacttgttccagcaccgatccaataggtccatgttgtcgtaaaaggcatatagcaggtcatcataaatgattcgtattcggcttcagtcaccggataattagaaacattcaacgtgccatacatcttcggatcaaaattatcctcacaactgcacatgataaatgcaatcatgacaaacaccttaaataatttattcttattcatattttcaatcttttctttcgttacaggttttcttagaaacatatttttgctccgaaggagtatgttctcgtcatcggatactccgctttggagccgtcaccccccgtctttatttcaggatcgacacctacaaacttggtaaaagtaaacggattctgacagtcgataaaaactctgatagaactcacataatcacccactcttcccagcttctttcctgaaaggttgtatcctaaagtgatattcctgatacgtacgaacgaagcattctgataatcttcctcaaaacctacgttaccaggcaaagcgacagcctttgttgaagcgataccacgacggtttccattctgattggtttgagaattccagatagtatatacatatttgttcgaattcttgggactcgtgtaatacacatctccgacaagtgcccaacgatatgcatagttatagcgtgtacgtccgaattgtccatacataaatacatccagatcaaaatctttgtatacaaatgtatttccaaagcctatgtgaatttttggaagtgtattccgcatctttacatcatcaatcgttattttattatccccatttgcatccttaataatcggataaccgggctgttgcgcatctaccggcaaagatttttgcgattcgggcatattacttttatctatgttgataacgccttccgtttcatagtaataataagcattcaccggttcgttcttacggattcgatattcttcataataataattgggcatccgttctttccaaacagcattatgatgtgataaggtcaattgtgaggtccacttaaacacacgggggatttcaaagttaagtgagttaatagtcgcatcccatccgtaacgtacataatgtccataattcatcgggacggaagatgtcatactaagcggagaggcagagtcatatcccagcaagttggttacatcattgcggaacatatcaaaacttccccagattctatcttttaaaacagaaaagtctacacctatatttttcatggtagtcttttcccaagtaacattcgggtaatcaggaccgctaagcagatagggtacataagtcactgaattgttggaaaacttgatatattgggctgccagactgaaagtgccataaagcgaactacccagattatcattacctgtctgtccataactaccacgaatcttcaactggtcaatccatgatatatgcttcataaacggctcgttagataatttccaggccaatgatactgaagggaaataggcatatttctttcccgggaaaaacttatccgttccatcgcggcgaatagtagcggcaactacatatctgtcgagcacatccacacttgccctggcaaattgagaacgacgttcatcggctgctctgaaagaagtcgggtagaaagcgccttccgcagcttccaccttatcagcagcaatgtgatcgttaatctgttcgtagtcaagttcaagaccatttgaatcgttcgtataccttcccataccgactacggcatcgacacgtaacaaatctccaaactgctttttgaaagtcaacgtgccttccatagtttggtttctacgttcaacatatcccaaatgccctcttgatttatacatgtccataaaatatatatcagaaggaacatacaagttacggttagcattttccttattgataccatacatcaagcggaaagacaacatatccttgattatatccacatcggcagcaaaatttagataataaccgcttgttttagtccggtcactaacttttatcatttcggccgggttagggtaatttgaatataaggtaggttttccgtcctcacctctgatcggtaaataagaaggataggttaaagccgattgtatggcatcatacccatttccacccccaccgccaccggaagttgagtttgtatattcattctcatttacattgacaattgctgtcaacttaagaaatggaagcaattgtgaagatatgtttgtccgaagagcataacgttccatagcggagttttctaccgtaccttcctgtttgtagtaatttccggacagataatatttcagcagtttagaaccgcccgtaattgtgatattatgattattgatgctaccatcctttaatacacaatccagccagtctgttgtttgagcggcagctatctgttgaggtgagaattgaggtacccatttattatcaaaaggtttatcaccataaggatacataccgttcgtaaataaatagttttctttattgaaaatgttggcaacattcatgtattcttccccactcaaaggttccagatacggatagtttttcacgatagaataatttccttcataagtgatttggggacgagtttcagtacctttctttgtagtgatcaatacgaccccattggctgcaccaattccataaatggaggcagatgcatcctttaacacttcgatagattcaatatcggcaggattaagtccggccaatcccgaacgattgatagagttgggcataacctgatttccgtttccaacctctaaagaagtggaaggcatcattactccatccactataaagataggagtacctgccccacgaattgaaaggtcaactgctccacccggttgcgggcttgtcaacgtagcttccagtccggcagcccgcccaagcaacatctgtgacatattacttgttgcggctcgcgatattttttccgtttttaccgttgcaatggaagtggtcagattcttacgggtggtcgttccataccctaccacaacgacttcatccaattgttttgaatcctctttcatcgtcacattcaacgtcatcggtcgggtaattttctgcgtatatgtagtgtaacctattgaagtaaatttcagtgtcgagccttccggaacttgcaactggtaattgccatctataccggtaatcgttccttgagtagccccttctatcatcacagtcactcccggaagagcttcgccggattcatccactactttgcctgtcaccttgaccggctgtttgttatcctgtgcccgagatgaaactttgtttaatacaatctgacgtttttcaatcgtataagatactccttcgcctttaaaaagtctatccagtaccagagtcatcaattcatttttcacagaaatacttacgatacggcttacatcaacaatatctttgttgtataagaaacgatattctgtctgattttcgatactagtcaagacctcctctacagtcacatttttcagtcgcaatgtaattttggcggattgtgccaggataggtatactgatagcttgcaaagctatacaaaacaaccatatagcacagattctccccatttttacattcgcaggtacattaattctctttttcatttttctaattgaaataagtttcatacctttacatgtttggttattggttctacaaataagttgattaacgaataactgaatctttggaaaggaaggtgagtcagaccttcctttttttttatcagttgtcggaagctgaattcactgattatgtctttctcatggcttgtattatttaaaggttaataaatgtgtttttctctcgtttctatcaataagacgtttctaaaaataaaagccacattggatatcgcattattttttcatctgcattattttttcttcaaactatcgtttatcccaaataatctttctatttttacccccgacaatagaacctttactacaatactatgccgaatatccaacaacagacttccgacgaccgttttctggtaatagcactaaaacaggatgataaacaggcttttacccgactattccatatttattataaagatttggtattgtttggcggtacttacatcccggagaaatctacctgtgaagatattgtgcaaaatatctttctcaaactatggaatgaccggaaatcattggtaattgagaactcactaaaatcatatttactgaaagcggtcagaaattactgtctggacgaattacgccatcgcaggattatagatgaacacattgcttacgaacttaaatcggattctatagatatagatacgacagaaaactacatactgtattctgatttatgccgacaacttaaaaatgcattggaacaattacctcctcaagaaagagaagtgttcgagatgagccgattagaaaacattaaatatcaggaaatagccaatcgcctgaatatctctgtcagaacggtagaagtacgtatcagcaaagcattgaagcagctccgcatcttattaaaagatttttatttactactttttttatttcttttccactaatgaatgtgggattttctttctgaaacgtctattatatataaggtaaaatgcattatgataaataaagattcagacatagagattataatctccagatatctctcgaaagaggctacaccagaagaaataaaggtactggatgattggatatcggctactcccgaaaactataggagttttctatcacaaaagaatgtgtgggaagtcagtcacccggcttttaatccggaagagatagatgtgaacagtgcgcacagaaaagtaatggagcagattctccatccaaaccagccggtttccgttcgtcctaagttgtccttcctacactattggcagcaagtggcagctatcttacttcttcctttactgatattatctgcttatctttattttaaacccgcttctcaaattgcagagacttatcaggagctattcactccttatggcacttggtcggtagttaatctgcctgacggttctaaggtttggctaaatgccggaagttctttaaagtatccgactcaattcaatgataagcaaagagttgtttcaatgcagggtgaagcctattttgaagtagaatccgataaagagcatcccttcatcgtaaaaacaaaacaactaactgtagaagctaccggcactgcattcaatgtgaacgcatacgctccggatcatgtagcagcagtgacgttagtaaaaggaaaggtcgcagttactcttgaccagaaaaagacgatttccctttcaccgggagagaaaattgactataatctagccacttctttatataacgtcaataagaccaacacttataaatggtgctcatggaaagatggaatactcatttttagagatgacccgctggaatatgtattcaaacgtttgggacagacttataacgtggaatttattctgaaagacgccgaattaggaaagtattcctataaagcgacttttgaaggtgaatctttaaatgagattttgcgcttgcttgaaatgagtgcacctattcgctgtaaagaggttagtaaccgcaacagcaataatgagaagtttgaaaagcagcgtatagaggtgagtaggattgtagggaaataagtttgtattagtacaaacttaatcgtatggcttcaaattaatttcatttggtagtattaagttgtacgacacccgggtctcatgcacaccgacacccgggtgttgaacatgctgacacccgggtgtcaagcagcatgagacccgggtgtcgtacaatttattcttgcagtatctttttttcttctctactataagttatgatcccaaccactattaattaaagtcattagtcccataacagtacagaaacgaatttattacttcatcttgtataccagcgttcctccttttacaatatcctcatgcgagattgttttcttcgtatatggttcgccattcaatgtaatactatctacatatttatgttctttcgacaaattctccgcaataatcgtgaaagtcttgccatcggccagatgcaaggtcatcttcggcaactgtggagcaccgaatacatattccgcacttaccggatctaccggataaaatcccatcgcactaagcatataccaggcagacatctgtccgcaatcatcatttccgcaaagtccgtcgggtttgtttttgtattgagtatcaaatatttcacgaaccaattcctgtgtacgttccggacgaccagccagtgcatacaaataagtcacatgatggcttggctcatttccatgagcatattgcccgattaatccagtaacatctgctaaactttcaccttctagcttaaccgtaaacaatgagtctaatttattcaagaaaggtttttctcccccaaacaactggattaatcctggaacatcatgttgtacatgccaagtatattgccatgcatttccttccgtataatctccaccgacactttcagaatgtgccaacgcacttgggttaaacggagctttccaagttccgtcagctttgcgcggacgcatgaacttcgtctccggatcgaaaagattcttataatagtcagcacgtttcgcgaagtaagcggcatcttcctctttacccatacgacgtgccatatcggcagcagcataatcatcatatacagattctaaagtggaagatacagattctgcttttatcagatctgtcgggaaataaccatatttcgtataaacctcccaatcagacttcaacggatgagatacagtctgcgtcttctttattatattgaaagcacgttcagcgtcaaagccacggaatcctttgcgataagcctcggcaatgactgatacgccgtgattaccaatcatacagaaattctcttttccccacaatccccaaataggcaggaagccttgcacttcaccctgttcgatgagagaattcacaaaaccgtccacacgttcgggaatcactaatgtataaaacggatgagcggcacggtaagtatcccacaaagagaacgtagaatagaaagcacccgttccagcctttactatagagtcggcagcattacgatacataccgtctacgtccgaaatttgattaggctgaatcaatgcgtggtagaaacaagtatagaaatttgtcttttcatcatcggtaccctctatttcaatacggctcaaatagttattccattcattgtgggcggcagttctcactccttcaaaatcccaggcaggaatttctgcttccagattctttttagccccgtctatgctggtggtggaaagagccactttcatcatcagctcgtctcccggctgcatgtcaaaagaggctatgatgcgttttcctttttctgtttcgcccatcggaagataaagtgaatcgactaccggacgattgaatttcatcacaaagaaataatcctgattgacccataccgtgttattgacatgccctgtcagtgtttgagcatcttcccagttcacttcacaactattaacttgtgaatgatattgttcttctctccatgcaggaccatgttgcaagtcaatcaatatagaggcagaatcagccttgtgataagtatagcggtgaagggcagcatggatagaggcagtcagttccgcttttacctgtggatcagagagctctgcggtgtaatatcccggagtagccgcttctttatctttagggaaatgactacgataagcatcccacgcacgggcacgtgtgccagtgaccggcatcaccaaaatatcacctaagtccatacatcccgttccattcagatgtgtttgagtaaatccccaaatcagagaatcctcataaacatattcagaacagtagcgccaaccaactgctcccgtcacaggactggtctgtatcataccgaaaggataacatgcgccgggaaatgtatgcccgttgtctgcgccaccgataaaggtattaacgtattgagtataatcttttgtatccgtcttttcagccggagtacaagaagaataaaaaaacaagcctgctgccagagttgcagccataaaaggggtttttcttctcatggtaaatataataatgttaagttaatgccgcattatatatgctgatatttatctaatttttcacgatagtagctttctacatctttccagtggtaataaggagctacgtctgttttcaccggtagtttagtttccttttcattaagtaatacttttaccaatacatcgttacttccttttttatgaaaaaagacgaattgcacgttactagccatcgggaaaatatcatacgctctccattgttcggataacttttctacatcagggtaagattcaccataatgattcagttccaataaagcgaccaacggtaacagacaagactcatggccaaatcttaaagtggcctgctttttaccttctttcaaagcagcatctgccctatctaaaatattacgtaacaagtcggcttcccgatagggcatcaaaccatccgttacaggagaacaagcgtgtgtcagataccaatataagttgttacagctccatagatcataacactcttcatccgtgaaaagagaatatagctgcatatctgtatcatgactctgcatattacaagccaaatcaaaaagacgtctcatcaggcgcgcttcatcaacgtttgctttgacatacgcttcgtctgtaaacaatgttttcatcaaccgttccggacgtacatgggtagcctcaaaatctttctgaacctttttcactttatcggaactagctattttactcaaatccttagcaggaggattcatgtaatacatatcatggtaacttgcatcattcttgatacatagattaggatttatcgcctgcaattggagacactcggatgtcatggataatatacaccggatgacaactgtggaacgggcatccacttctgttccatccgcaaatatttgtgggaaattagtatacatacgctttgcaattcctctgtgttggcgtgctcccaccgaagtcagttcaccaagacgaccttccgccatatcagccatgcgcaaaacaatatccagtgtgtttttacctgttgcagtaagtttgtttaaagaatcggcttttaataaagtttgcttggggaaacgataatcattcggatcaatcaaataccgtgaaccatgacgcatatatgtactgatataaaaaggttcgtaccccttaggagcagctgtctgcttggcagtaggcgtgggatatgcataataattattagcggataaataccggtttgcacggatctcttcacgagcagtttgcgcttgtaccgtccatacaaacaagagcaataaaaagatagatgtgagttttttcatgatagtattattcaatgtattaatagttgtgccacaaaattagagatttcttctcatttaaaaggatttgatacagacaaatatacttaaatcttaaatgaaggaagttcctatttatatggattcgctgtgataaaacaaaaattcgtacgacttattgaataaatatcaactcaattatttatctttgttagcttaataacaagctggcgcaaaaaacaataagtataatgaaagatttcttgaaatttacacttgccacggtgacaggtatcattttgtcaagtattgtattatttataatcagcatggtaacgttgtttggcatcatgtctgcttcggacacggaaacaatcgtaaaaaagaattctgtaatgatgctcgacttaaacggaacgttggttgaacgtacgcaagaagatccgctgggtattttatcacagttgttgggtgacggatctaacacgtacggactggacgatattctttcttctatccagaaggctaaagaaaacgaaaatattaaagggatttatctacaggcaaactcattaggcacctcctatgcttctttgcaggaaatccgcaacgcactgctcgacttcaaagaaagtggaaaattcgttattgcttatgcagactcctatacgcagggactttattatctttccagtgcagccgataaggtgttgctcaatcccaaaggaatgattgaatggcggggtatcgcctctgctcccctgttctacaaagatttgctgcaaaaaataggagttgagatgcaggtgttcaaggtaggaacttacaaatctgccgtagagccgtttattgctacggaaatgagtcctgccaaccgcgaacaggttaccacatttatcacttctatctgggggcaggttacggaaggggtatctacttcacgcaatatttctgtagactcactgaatgtttatgcagatcgcatgctcatgttctatccggcagaagagagtataaaatgcggattggctgatacactgatttatcgcaatgatgtgcgcaattatcttaagaaattggtagagatcaatgaagatgataatcttcctatattaggattgggcgacatgatgaacgtaaggaaaaatgtgccgaaagataaaagcggtaatatcgtagctgtttattatgcatccggtgagattacagactatccgagctctgcaacttccgaagacgggattgtcggttcgaaagtcattcgtgacctgcgcaaattgaaagataatgatgatgtgaaagctgttgtactccgtgtcaactctccaggtggaagcgctttcgcctcggaacaaatctggcatgctgtaaaagagctgaaaacaaagaaaccggtcattgtctctatgggtgattatgctgcgtcaggaggttactacatctcttgcgttgccgatacgattgttgcagagcctactaccctgaccggttctatcggaatcttcggtatgattcctaatgtgaaaggattgactgacaaaatcggcttaagttatgatgtcgtaaaaacgaataaatacgctgatttcggaaatatcatgcgtccgtttaacgaggatgagaaatcattgcttcaaatgatgataactgaaggatatgatacctttgtaactcgttgtgccgaaggacgtcacatgacgaaggaagctatcgagaagattgccgaaggccgtgtatggactggggaaactgctaaagaactgggattagtagacgaattaggtggcattgacaaggcactggatattgctgttgcaaaagccggtatcgaaggctataccgttgtgtcttatcctgagaaacaagatttcctgtcttccctgcttgatacgaaaccgacgaattatgtagaatcacaattactgaaaagtaaattaggcgagtactaccagcaattcggcttactgaaaaatctgcaagaacaatccatgattcaggcacgtattccgttcgaactgaatataaaataaaccgtaatacatggacgaacactttatcaagatacataagtggctctaccctgcctcctggctctacggagcagtggtaatgatgagaaataaactctttgactgggaagttcttcaatcaaagagttttgatatacctatcatcagcgtgggtaatctcgctgtaggagggacaggaaaaactccacacactgaatatctgataaagtttctttgtaatcaatataaggtagctgtattaagccggggatataaacggcacacgaaaggttatgtattggcaactccggaaagtacggcaagaagcattggcgacgaaccttaccagatgcatcaaaaattcccgtctgtcacagtagctgtcgatgaaaagcgttgtcatggcatagaaaagttgcttgcactgcaaaagccttcaatagatgttatcctattggacgatgctttccagcaccgatacgtcaaaccgggattgagtattctgttaacggattatcaccgattattctgtgatgacactttgctccccgcaggacggcttcgtgaaccaattagcggcaagaatcgggcgcaaatcgttattgtcaccaaatgcccgcaagacatcaagcctattgattataacattatcacgaaacggctgaacctttatccatatcaacagttattcttctcatcgttccggtatggtaacctgcaaccagtgttccctaccatgtctccggacacaaatgcaatttcgacaaaccatgaggttgctttgtcctcactgacaaacactgatatattattgatgacgggaattgcctcacctgcccctattctcgaaagactggaaggttgtaccaaacaaatagatttactatcgtttgacgatcaccacaatttcactcatcgggatatacagcttatcaaagaacggtttcataaactgaaaggagaacaccggttgattattaccaccgagaaagatgcaacacgcctgattaaccatccggctttggacaaggaattgaaaccatttatctacgccttgcctattgaaattgaaatattacaaaatcaacaagataaatttaaccaacatattattgactatgttagagaaaatacaagaaaccgcagcttatctgaaaggtaagatgcataccagtccggaaactgctattatactaggcaccgggcttggcagtttggcaaacgaaatcaccgagaagtatgaaataaagtattcggatatccccaacttcccggtatctaccgtcgaaggtcatagcggtaagctgattttcggcaaactaggcaataaggatatcatggctatgcagggacgcttccactattacgagggttattcgatgaaagaagtaactttccctgtacgtgtcatgcgtgaattaggtatcaaaaccttgtttgtatccaatgccagtggcggtacaaatgcagatttcgaaatcggtgacctgatgattatcactgaccatatcaactatttccccgaacatccgcttcgcggaaaaaatatcccttacggacctcgcttcccggacatgagcgaagcatactgcaaggaattgattagtaaggctgacgagattgccaaagaaaaaggaattaaagtacaacacggagtgtatattggtacgcaaggtcctactttcgaaactcctgccgaatataaattattccatatccttggtgctgatgcagttggtatgtctaccgttccggaagttatcgtagccaaccattgtggtatcaaagtttttggtatttccgtcattaccgacttaggagtagaaggaaaaatcgtagaagtaacacacgaagaagttcagaaagccgctgacgctgctcaaccgaaaatgaccacgatcatgcgcgaacttatcaaccgtgcctaaacaatcatcccgatttatgagaactgaaatagcatctctcggtgagtttggtctgattgaccgcctcaccgagggaatcaaactggaaaacgaatccagcaaatatggagtgggcgacgatgccgccgttctctcctacccttcagaaaagcaagtactggtaacaaccgacctgcttatggaaggtgtgcattttgacctgacttatgttcccttgaagcatttgggatataaatcagcagtagttaatttctccgatatttatgccatgaacggtactccccggcagattacggtatctcttggtctttccaagcgtttcagcgtggaagatatggacgaactttattccggtatccgtctggcttgccagcaatataatgtcgacattgtgggaggcgataccacttcttccttgacaggccttgctatcagcatcacctgtattggcgatgccgacaaggataaagtagtttaccgtaatggcgccaaagacactgacctgatctgcgtcagcggcgacttgggggcagcctatatgggtttacaactcttggaacgtgaaaaagtcgtattgcaaggtgataaagatgtccaaccggatttctccggcaaagagtatttattagaacgccaattgaaaccggaagcgcgcaaagatatcattgagaaattggcagccgccaatattgtccctacttctatgatggacatttccgacggcctgtcatcagaactgatgcatatctgcaaacaaagcaatgctggttgccgcgtttacgaggagcatatcccaatcgattatcagactgctgttatggctgaagagtttaacatgaatcttacgacttgtgccttgaatggtggagaagattatgaactactctttactgtttccatcgccgatcatgagaaaatttcacaaatggaaggagttcgtctcatcggacatattaccaaacccgaacttggctgtgcattgattacccgtgatggacaagaattcgaactaaaagcacagggatggaatccattaaaagaagataagcaatagatttcatcacatacctgaaatatttttcatcttatacaacactgataattagccgactaactttttatcagtgttttttatttccataagacttgcagaatccaaaagtttcactacctttgcaaccgcaaaagagatattaccggaccgaacaagcatgaggtgccatagctcagttggtagagcaaaggactgaaaatccttgtgtccccggttcgattcctggtggcaccactaatgattcggtaataaaaaatcccttgaacttttgaagttcaagggatttttttattcctcgtattgcaatttgcaaccgcctatactttagaactatgcagttttttataaatctccacacgagcatctatttctgcttgagtcaaatgcgcaggaagttcaatggtagtccgcggagttattgctaccaataccatatctcccaaaccctttttatactctttaataacattttcagtaaactgactggatgaaataacatcacgcattatattaccttttttcatatctctaattattttgttttttattttacacacaagcagaatatacacttccctatacaggtttagattgagctaaatcttccgatgtagatttgttttccaaagagatattgatcgcattcatgcctttcactccacgctcaaggtcaaatgttacgatattattttctgcaatattgccaatgacattgttcacatgaaaaaagtatttctcaacacctgaaaggtctttaataaagccaaatcctcttgactcattaaaaaactcaacccgtcctctcaaaatcgtcggctcctcttcttcctttttaggagttgctataattatttcatccggattaatttcttccttctttatatcctctgtcggaggagtcgaagttatcattccgttctcatctacataggcaatcatatcctcaaagctatttgagctgcccgataatttcttgctttctttctttttcagtttttcttctcgtttagcgagtcttttcttttcattttcacgtttaccaactgtcatggattttgccatagaatttatatttagttttatattaattttaaagagattgttatttgttgatttcaaatagtataactggctttattcagcttcttacccgtcagtttctgaatatcattaacgagtttacgctcttcctgcgagcagaatgtcagtgctgtccctgtattcccggctcttccggtacgtccgatacgatgcacatacgtttccggcacatcaggaagatcatagttgataactaaaggaagttcgttaatatcgatacctctggctgcaatatcagtagccaccatcacacgtgttttgcccgacttgaaattgcccaaagccaactgccgcgctgcctgacttttatttccatgaatcgcctggctaccaattcccgccttgcccagtatctttacgatcttatcagcattatgcttcgtacgtgaaaataccaacaccgactgatcttctgatttttgcaaaatcgaaaccagtaaaagactcttttcctttttctctacgaaataaaccatctgttcaatagcatccacagtcgatgatttcggagttatgctgattcgtacaggattcttcaacaaagaattcgttaaagaaataattgtatcaggcattgtagcggagaagaataaagtctgtttttctttcggaagttttggtaatatccgcttgatatcatgaataaatcccatatcaagcatacggtctgcttcatcaagtacaaaatattgtatcttatccagatggatatgtccctgattcatcaagtcaagcaaacgtcccggtgtagcaaccaggatatcaattcctttgtgtaacatgtcaacttgaggacgttgatttactccgccaaaaataaccccatgccgcacttgggtatatttggcataatcattaatgcattcacttatttgcaaggcaagttcacgggtgggcgtcaaaatcaacgctttaatcccccggcacttggctgcctctttattcatttgcaaatgttgtataatgggaatagcaaacgaagcagttttacctgttcccgtttgcgcacagcctaatatatctctttttgctaatgcagccggaattgcctctccctgaatgggagtgggcactgcatatcctttttcttcaatagcttttaaaatcggttcggttatatttaattctttaaatgtcataattgttgtttttgctgtatcaaaacagctattaatttatattgtaaagggactgacaaactccatcatgggaatgaaaatcccgtaggttaagccagtttatgggttgccaagaaaaactcgcgctccagtgtactcattacttcttttacactactgattttttcagcgagaaaagcattgctaccggcaaaagcatagccttttttcatatttcctttggctgcattatataaagccttaataatgcaataagggctttttgtataatcacatgttttgatacaatggaatgagcaactcttaggcctctccagtccactattcacattgtgaataaattccccgtcaatagctcgtcctggcattcccacaggactttcaataataagaacatcttcggacttggagtgaatatatacttccttgaacgtctcggacgcgtcacattcctgggtggtaacaaagatacttcccatttgtacccctgcagctcccagtcccataaaatgtgcaatatcttcacccgtcgaaatgccgccggcggcaatcaccggaatctgtttctgttctttatagctggatgcaatcattaccacttccggaatcaaagtttccaaagcataatgctgatcctgtaattgttcttttttgaatcctaaatgtccaccggctttaggcccctccaccacgattgcatcgggcagataattatagttcttctgccatttatcgcagatgattttggctgctcgtgaagaagatacaataggcactagcttggttgtactctccggagtcagatatgaaggcaggtcgagtggaagcccggcaccggaaaataccacatcaatcttttcctcgattgcggtgcgcaccatatccgcataattcgataaagcaaccatgacgtttacgccaataataccttttgttttcgcacgtgctttccggatttcctctttcagcccgttaatacatttttcaggataagtacctttccctttggggtataacaaacctaaacctgcgcatgatataacgcctactcctccttcgtttgctactgccgaagccaaacccgagagcgagatacctactcccattccaccttgtattacaggtgtttttatctcaatatttcctataaagaatgatttcatatgttttattttgctttagagcaattgaacaagataaacagtgtgagcacactttattcaagcgctcaagattggccctgtcattgactatttgccttgttgggtgtaatttattaaacctttactcctgacttcttcaagagtattgtgtattacaaaaaagtctaataaatctattttcagaatggaaagtgcaggagtagatattcctgatattgcacagaaaaagagccagaattagcagaacttaaatgtaatatgattttttgtcttcccctgtgtcaatcagaagattcctccgttgaatcatgaaacggaaataacttattaaataaaagcagaagatattatcttctgcttttattcggatattaatatcttctagagttattataaccaccacgaccaccaccgttagacggtctttcagtacgaggacgtgccacgcttactgaaataactttctggtcgtattcaactccattcagttcgtcaattgctttttgtccttctgtatcattcggcatttctacgaaagcaaatcctctggatctaccagtttctctgtcaaaaattactttagctgaagaaacttctccaaactctgcaaataaatttgttaagtcagcatcattagtgccatagcttaaacctgaaatgtaaatgttcatttaaaattttattaaaataaatactaatttggagtgaggaggataattaaagacaaggactgcttgctaataaaatattataaagaagaactatacgataatgattcgtaactcaaactcttggtacaaaggtaacacaataaatcagaataatacatttatgcccgttctttttcggaagaaagacgataattatcatttattagcacacaattcatcctaaatcggcgagatacacaattttgcctatcattcttgatattctcttgtaatatatctacttttgccattacataaattatcaagtcccactttatggatgtcagaatagaaccaagttggaaacaacaattacaagaagaatttgacaaaccatacttcgaaaagttggttacattcgtcaaagatgaatacaaacgggcacacgtcctccctctcggacatcagatttttcatatattcaattcctgtcccttcgaaaaggtaaaagtagttatccttggacaagacccctatcccaatcccggacaatattatggagtctgtttttctgtgcctgatggagtagctatcccaggttcactaagcaacatcttcaaagaaatacaccaagatttgggaaagccaattccaacttctggtaatttggatcgttgggtagctcaaggtgtattcccgctaaactctgttcttactgtacgtgcgcacgaaaccggttctcatcgaaatatgggttgggaaatcttcacagacgcagttatcaggaaactaagtgaaaaacgggagaatttgatatttatgctttggggaagttatgcgaaagagaaacgatctttgatagataccaacaaacatctggtactaaccactgttcatccctctccccgctctgccgaatatggtttcttcggttgtaaacacttcagtaaagccaatgctttcttgcatagcaagggaatagaagaaattgattggtaaataaacgatttctcaaaacagattatcagtacccaaaaacattcgctatgaataaatcaaacaatatcactcgggaagaaatgtgggcaaagcaatgcttgtctgctaccgatattgattacgctgtgtgggaacgggataaatccatacttcaccaactttcaaaaatctgtcacaactgcacatttgttgtcgatgtttacaaatgcaattacacgtatgcatcctcgaatttcgttgatttactggggtatgacagtcacaagatagaaactttggaaaagcagggagattatttagaatcacgtattcatccggacgaccgtgcgcaactggcagcattacaggtcacgttaagccagttcatttacagtctgcctctcgaacagcgaaacaactattccaacatttacagtttccgtatactcaatgccaagcaacaatatatacgtgtcactagccgacatcaagttttggaacaagaccgtaacggcaaagcatggctcgtaataggcaatatggatatttcacccgaccaaaaacattccgaaacagtagactgcactgtcctaaatctgaagaacggagaattcttctctccttcctctttgctaatgccttcttcgctcaacctcactaatcgggaaatagagatattacggcttattcaaaaagggttgttaagtaaagagattgcagacaagctatgtatcagtattcacactgtcaatattcaccggcagaacctgttacgcaaattaggtgtgcaaaattctatcgaagccattcgtttgggacaggaaaccggactactaagttaattaacccatacgcactcttcccgaagctaccagtctgtctaaggcatccattctaccacacccaccgccggatgcaatcttctccattcctcaaattccggataactacgtacaccatcctgaatcacagcttgataatactccactcccataatcttttccgtatcaggcgtttcgtatttcaatttcaggatagccagtctcatttcatctgtcaataccgcagaaatgcgttcggccaccctttcaaaatagccatcataacgagagccttcttggatatgaatcatatccatttgccagagttctccttccatatcctgataccatgcatgccactctatacacgcttctgctgtatgtaataaattcgtatattcaatcttctttacggacgtattttccgccaattcagccatcgcccgaaagctggcagacaaatccaaaggggaagtataaatatgaaaatcaatatcccgatgtttcatcaataatcctgtacgcaacgaacctaccagattcactttggcaccaatcccctcccatatccgaacaatacgggtatcctctataatctcccaagctttctgctggttacgttttgccaattcaagaatattcatctttttccttattaagtaagtatgcaaaaataggaaaaaggatacatatatagctataaataactatttaatcccttaatgggttgagctaactttgtccgcaaattcaattcttcaccatacaactaaaaagagattatgatattcaatcaaacagagaaacaggaaaaagagtatttacagcaagtcataaccactatccatgatacaatcaacaccaccagtacttccgtcaaagagcatatagacaccctgcaggagtacaaggattatctatggtcgaacaaagatattgatccccacgaaatccgttccatgcgcgaaagcatattaaatcattttgcattaggcgaaaacgtaattgacaaacgcaggcgactaagcaaaatactggatatcccctatttcggacgaatcgactttcattcagcgaaagacaaaagccaagttagtccgatctatataggaatacacactttctatgatttcaagcaaaaacgaaatctgatttacgattggcgagctcctatttcaagcatgttctacgatcatgaattaggcgaagcgacctattcttctccggcaggtgaaattaatggaacaatcttgctcaaacgccagtaccgtattcgtaaaggaaatatggagtatatgattgaaagttccgtaactgttcatgacgatattctgcaaaaagaactatgctccaatgccgacaacaaaatgaggaatatagttacgaccatccaaagggaacaaaatcggattatccgcaatgaaaatgccgccgtacttatcatacaaggcgttgccggttcagggaaaacatctattgccctccatcgtatcgcctacctgctttacgcgcagaaagggcagatttcttccaaagacatattaattatctcacccaataaagtatttgccgattacatatcgaatgtacttccggaacttggcgaagagaccgttcccgaaaccagcatggaacaaattctctcaaatgtacttgacaacaaatataaatgccagactttctttgaacaagtaacagaattattggaaaagccgacacaagactttatcaaacggatacaatacaaagcctccttcgagtttatatcacaacttgacaagttcatcctttacatggaaaacaactatttcaaagcaacagacgtaaaactcaccaaatacatcactattcctgccgaatttattaacgaacagttcaaacgattccaccgctatcccatacgtcaacgatttgagactatgacagattacattctggaaatgatgcaactacaatataatctcacagttagcactccggagaaaaaccaactaaagaaagagataaaaaagatgttcgcgggaaataacgatctccaaatctataaagacttttttgagtggatcggaaaaccggagatgttcaagacacgcaaaaaccgcatactagagtatgcggacttagcccctttggcttatctgcatatcgcattaaatgggaataacgcccaatcttacgtcaaacaccttctgatagacgaaatgcaagactattctcccatacaatacaaagtgattcaaaaactttatccgtgtcgaaaaacaattcttggagacgcttcacaatccgtcaatccttatggatcttccactgccgatatgattcagaaagcatttgcaacaggagaaataatgaaactttgcaaaagctatcgttctacttttgagatcaccagttttgcacaaaaaattcaaccgaacaatgaattagaaccgattatgagacatggggaacaccccaagattcttccattcaaaaatacagaagaagagatccaaggtattgcggatttagtaaactccttcaggaactcccattatacctcattagggattatctgcaaaacagaatcccaagcaaaagaacttgttcaaaagctccagatatatgcaaacgacatctcacttttgtccaatcaaagttctgcttatgtaaaagggattatcatcacttccgcccatatggcgaaaggactggaatttgacgaagtaatcattccgcaaacagatgataagaactatcattccaatattgataaaagtatgctttatgtggcagccacaagggctatgcacaagctaactttgacttattctgtttcttcacccagttgtcgattcctgtaatagaatataacatcgaaaattaaaagaactacccgcaaaacaagagccgcttgaacaatctcaaacggctccgtaactcctttaacaacatggttatcgagctaatacaaccaccggtctatattccttttttctgcactgaactccactccaactttaaccaactcacgcccgtctacctgataaggtatcagatagcctttttcatcaatctgctgcaaagcctgttcggcagtaccattcagtttaaattcaaatacataaatatacttcggagttttcaccactgcatccgcccgtccgcgggcactacgaacctctgctccggtaaattgtcccatcaatttgaatactaagtaaaatacaacttgataatgtcgttcggtcttttcattcagttcataagggaaatctgcgaagaaagcttgtaagcgggtaagaaaagcgtcaacatcaccactctccaattcacgtacaaatttacctagataaaagccccgttcatcatctaccactgatgtgtaataaggaaccaaaaaatccataaatccatatcgtacttcatcattgggaaatttcagcaggtagtttccaaaacgcttgtcatacccctttatagtcaaatagccactctgataaatcaacggaatcggattattagcatctaccctatattccataaacgaagaagcattggcttctaccccatcaatcaacgtacgcaaatcatactcactctttttaagcagttcgactaaaaaagtaggagtaccggtttggaaccaataattactaaacttatacccgtcaaaaacgttaagcacactgaatggattgaatactccttccgcaaactcacaaaaatgataaccgtcatataaagccgtcatcttatttaatgtttcttcataagtcagttcatttgtttctgccaatcgattcagttcaggaataaaagtatcctccaattcttgtcgtgtaataccacaaatcgtggcatactgcggcttcatactgatatcattcagttgattcaaatcactgaacacactgacttgcgcaaacttagtcacaccggtaaggaaaacaaaacgaagataacggtcagaacttttcagtacaccatagaaggccttcaatgtcttacgatagtcatcaagcaaagcgtcatcacccaatgcctgcaacaaaggtttatcatattcatccaccaagactacgactccacgaccagactgttcacaggctcggcgaattacacccgcaaaacgtccggagagagtttcctcatcctcccctttgccatatttcagttcccattgcgtcaactgcctgctaagaatttcgactaaagcctggggagaatcatatttttccgcgtttaaatccaaatgaaataccggatatgtcttccattccttttccatatcagctatggccaacccttcaaataattctttcttaccttcgaaataagcttcaaaagtagaaagaagaagactcttgccgaaacggcgagggcggctcaagaaataaggtttacctgtgttagctattcgccacacaaaagcagtcttatctacatagagataattttcttcacgaatctctgcaaaagtctgtattccaataggaagtttacgtaatatcccgtccatgatttttcctctattttgattattcaaagatacgcatttccatgggaatacacatacaaactccacaaaaaagtacacagtttcacagacagcactaccatgactccatttttcatcaaaactaactttgtaccagacaaacaacatctcacttcctcttcactttgcaaatccaacacacaagaaccagaaccagcaaaataattccgtaccaatacccacttccggttgtcctattagtagttttctcaactcccgttttatgaatctctgtcttagcgctcatatccgataagctcacagactgtgaattcacttcttgaagaagttgtttctcattaacgtttttcctatccaccacagtcttcaccaccatcccagccttcaatctaagcgtatccacaggaaatacaaacaacacctgctcgatatgctcctccaccacctccaaatccttttctgaagcaaccttatttttaacaagacttttcccggagctactatttaaacttgaatcaaccctaacttcactctccctgtttatcacctctttcttactcctacatcccgacagcaatacaggcacaaccaaagccaccaccaatacaaacagtaactccctcccactcctcaaaaactccttcatatcaaaacagggacaagccttcacatattcataaggttcaatcactccgtcaccattcaaatccggtgaagtatcccgatgtcccaacacttggagaatattatattcccgctgcaaatccataataatctgataaagcacccgtttttgagcattcgtccgggtatctgccggacgcccgttcccatccaatccaccgatataacatatcgcgatactctgctcattccaacctttacaatgagcaccgggcaaagccacatcccgccccttttccaatttcccatccaaacggatcacatagtgatacccgataccgttgaacccacgttcccggtgccaacggtcaatatctgtggcagtaaaatcctgcccggctttcgtagccgaacaatgtactatgatagaatctatatttctcatgataattcattattagttcaaacgcaccagttaataatccgaaggtggcatacgcttcacacaccctctaatctcacacttcttcacttccgactccttctgtatcaactccacttcatgacatttatgtatccagtcaatcttctcttcctgctccttgcgaagttcaatataaagcccgtctatcttctcgtcacgttgagtcagccgttcttccaaccagtccacctttttacggcgattttcttcttccatactgttcacggatgcttcctcttttcgtgcatccgtcttgcggcaagtgatatacctcactaaccatttcacagcttccaaaccacccatagcggtaataaaagcaaggattgtagttatttgcatatttatatttttacgtagttataaagaaagaatgaggccgaagccccattccatacaaaccagacagttctcaacggctcatgaatcaagcagctgggtctggtgcttcaccattaccacccgaaccaccatccggatccggagtttcacccccatcatccgaaccgtcaccaacactacccgaatcattaatatgatccaaatccttgaacttcaatccatccgaacgggtagtcgtcccggtaaacagacgaatgtccgagttagcacgaaaacagatacgaagccctgaaatattagcgatcgtaaaatcttccgccttctccgtccctttgctttgggcagaaaggtaaaaatatcccagaccggcgatattcaccgaacggccacccagcaatgtctttctcaataacgtacggaaatctttcaatacactaatcgtttcaccctcgctgacaccggaagcagacgcaatctcctttgcaaactcatccaacgttgcactcgtatcatactgataagaaatcaccggatacactttctttcctgcttctttatttgtagggtcacacaggcgagacacccttctaaatctaatagccatactacttttcttttttaaataaatactgttttaattatcacttcgctaacgttaacgatgcaaagatgcagcatcttccacggagatgaaacgacacctaatagcctcatcagaaaagtactaaaaagcatttcagacatacgcaaccgacataaaggaactaaataaacgacaaaaagcaaggaaaaagcgacaaaaccgatagccgggggagaataataaacaaacaaatatattcaaactaataaataccatactaaaaagcatggaaagttttaggcgctcaaggctgtcaatagccagataccgtatattgaaagagagcaaactgcaattatgccggtatatcgaaagcaatgaaaaccaagaattgccgagattgttgcgagatgattcgggcaagattgtctgatatatgttaatatttcatggtaaataagcatttccctgtacaaacgcactacaatcacgaataaatgtggtatatttgtactaaaataaagagtataggcatggaaagcaagagatataataacagttttacttcctctagtatggtaaaggaagaaggtcggacagcctattataagctgctggacagtgtgcgtgacggagacgcggtacgcatcaaacggggcgtatatgccacagccgagcagttggcggacacgatgatagatgtggaagccatcattccaggcggtgtgctgtgccttttctccgcatggaatgtgcatgggctcaccacctcattgcctcaggcataccatgtggcggtaaaaagaggtcgcaaaatcacgcttccaacatttcccaagatagagctccatcatatcacagacacgatgtttgacataggtgtcgaggaactggttgtaagcggttaccacatacatatatataataaagagcgatgcgtgtgcgatgcagtgaagtaccgcaacaagataggcatggatgtttgttccgaagtggtgaataactacatttcccagccagacagaaatctatccctgctgatggattatgccgacaaactaagagtaaaacgaatcctcgaacagtatattgcaataaaactatgagtgaaatcaaaaatcctggaaagtccatccgggcaaagctgctcaatgtagccaagcagaaggatgtgttctaccagaccattctgaccagatattttcaggaacgcctattgtaccgtatctcacaaactcattaccgtgagaacttctacctgaaaggtggagcactgatgtatgcatacgaacactttgctgcacgtccgacattggatattgattttcttggcacgcatatcagcaatgatggcgaacgcatcgccgaggcgttccgtgaaatatgcgctgtagagtgtgaggaagacggagtaaggtttgctgccgacaagcttgcagcacagaacatcaccgagttcaaagactaccacggtatccgtctaagtattccggcgacaatggacaccattgcccaagtgctgacaatggacattggttttggagatgtggtaacaccacatcctgtatcattagattacccattgttattggaagaactgccagaagcaaacattcttgcctattccactgaaaccgtaattgcggagaagatgcacgccatcatagacttagctgaccaaagcagccggatgaaagactattatgacatctaccacctgctcacatcattcaaatatgacaataccatattacaggatgctatcaaccgcactttcgagaatcgtcatactctttataatgcagatacgatgttcttcaggaaagactttcccaaccatacgcagatgcagttacgatggtcaacatttctaaaaaaggcaactatcaaaaatagcctttcattctccgaggtggcacattggctgcaagaggctttaatgccatattgggaagcctatggacgtatgtaatacttccgaccattaatacattatacaaaaagagtgcaccttcttccccaccgggaaaaagatgcaccacacaaacaaaacaaacaatagagcgaccttcacaggcagcgtagaacccatgattccatttttcctatgctactattataaaaagaaaaatggcaggggcacggattcccttggggaaatgaggcgcttcacagcgacataaaggatataggccattaaactcatttattatactatatggggaaaacctacatctttttctattctcacaaaaacatgaaatgaaacaattaatttccttttattgttttccagactggcactgctaccaccgcaccgacaatcggagccacaataaacaaccaaagctggctgatagcctccactccggcaaacaatgccggaccaatgctacgggcaggattaaccgatgtccccgtaacgggaatacatacaatatgcaccaaaaccaaagtcaatccgatagccagcccggcaaaatgaggactgccattatcgcggtcggtagtgcccaatacagtcagcacgaagataaacgtaaacaccgcctcggctacaaatgcagccagcagatacggctcttcaaaaccgttggctcccgtaccttctatccccattgtgtcggtaatcaaccacagcaatgcagagccaagtattccgcccgtcacttgcgctacgatatacacaccggcttccattaccgacagtccgccattcagccaaacgccgatggtgatggccggattgatatgacagcccgaaacaggaccgattgtgtacgccattgccaccaccgacaaaccgaacgcgaaagcaatcgtcaacaccgcggctaccgatgtcgcgccgccattcaatacagcagcgccgcatcccattaagacaagcaccatagtgcccaccatttcagctataaatttcgttttcataatctactttttctactcgtataagatatactattctctctaatcatcctcccattccgaaggcggcaacgacttcttcccataccatttcatccagacacgagatttccgctttctcaaataaagcgcatcgctacaatgctccaacgcttcccagtcaaatgaagaatgatgtccgaaccacctctccagccagtaaagcagatgataactcatgaacgcaagcaacatccaccaccacgaaagccagacggatagcgccaatgcaggcaataatgccaagaagaaacactccgtatactgtcgcgcatgaatctgaagttccatctcctcccacccttccaaatatttaaaccgggtgaaacaacaaccgaaaatcataaaataatgccttttcttcctgttcaggaaagttttcgccaacagactattatatattatcatatcctcctcttcattcaaaaaagcaacattgcaaaggaccatccaactaccggccgacaagcccaccttgtaacgacaaagcactttcagtcccgacatagaagaaaacgagacagccccgcaatgttgcctgaaataccttgaaatgaaataaaactattattcgacgattacgacgcggttcaattcaggttcactgaaacggttgttcgtatcgccctccgctttcttcacgagacgttcaggggaaattttatacttttcgactaataaattgtacacatattccatacgttgttcactcaaacgttggttcagttccttgctacccgtagcgctgtccgccgaaccaatcagcgtgaaagtcttgttcttatccgccttgatggcgttgttcacataaaactcaagattggtaagttccttcttatccaaagtagccttgccgatagggaagaacaaggctaccggcgaagcagtcactttcgattcattcaccacttccggtttccgatttctggcagcttccagttcggcggcaaggcgctctgcttcggtgctcaaatcatggttcttggcacgaagcgcgttgatacgttcattataagatgaataatctgccggagccactttctcgacgcggtcgaaacgggtcttgcccaacttcacgcttagccccagtgtcacagcactcattccttcacctttgctgccgcctaccgttccgtcaaaacactctttcactagcatctgccgtccttccaaagtcaagtccagacgcttgcccagacggaacgtattcaaaataccgatgttggcggcaatttcattatcatgcgtgctgtttccccacgaacgtgcccaaccgaaaccgacaaacggaatcacattccacacacgtttctcattgaatccgaggaaaccgttcgaccagttccacataaagtccgcatggagattggaaacattaaactcttccttataataaccgcgatgcgcccctttggcatacattccgcttgcgtccgtcagacctttggctttcagacccgaatattgcaggcggactccgtaagaaggagttatccacttgcccaacgacacatccagtgcaggagcaatacggttgcccaccgatgtcttgttatcaaattcaccttcatagatattgattccaccgcctacaccgatataccagttactccagaaactattcgtttcatacgagccacggagaatatttccgtccgtatcacgattttccttttgctgtgccatggcacagactgatgataataccaatgcaactgtaataattttctttttcatgtttcaatttttatgttcaacatttagtttaacctgtttctttactctaatttcattttacttccgggacggaatttcacttgtcgtttggccggaatcagcattgatccgcctgtggcaggattatgcccgttgcgtgctttccgttcctgaacgacaaaactgccgaaaccgactaaagtgacactctctcctttatgcattgtttccgcaatggtttccatgattgcatctactgcattcgtagcttcgttaaagctcaactgacctttaagggctacttctttgattagttctgatttgttcataggtttgtatttaaaaatgaattatatatgtttattcgtcacggatacagcggacaggtgctgccgtagaacgatctaaccagtaattattacccccaccgaagccacagccaacatcaccattttttaaatcaaatccaaatgacattattacattcataccactgccatcattatatctcattgtcccacaaagatgagcactataaaaaggaccatttactacccctttatcataagttcttccatggcgaagcgaagtagaaataaaatagactttccgtgtactattttcactaccacaatagaaatataccccatacttagtaaataaaggagtataaaaatctcccttctccatatgtcccaaaaattcggttccgcttttgccaataggggaatctattattggatattttaaaaatgcaccatatacatccggcggagatactttgtaaccaacaggacatggatcataaagggtcttcattgtctctacattaaccattttatattgcgaataagggttatttccccataaatattgatttccagtcatatcattattaccggattcagaagtataatacaaccaatcatgaacactataggcatcatcacttatgataaatacggcaggatgatttatcgcatactcaattgttcctatactttcatttttttcctcctctttgtgctttagtttacttccacgtacattatgcataaaattttcggtactttcaaaggaagctgaaatacaaaaaggatctttacgcccccattggtaacccaaaccacgtgttgttaactcatcaggagtattagttgttgctcctaaatctcgatccattattctataattcttcccgctataagtttctccattggttggtaagcctaattctattatagtggggtgctctgtacaccaaacatgccaactccatagtactgtagcatcctccgcatttggatcttgtttatcataaactgcaataaccccatttcccgtaccactactcaagaattcaactcgattagtagtagaattaaatgcaacttgtgatataagattttgcttgtcctgccaaattagttttgcagaataaggaactatctcaacatttttagaaactgatatatcttcacctgaagcatttttaaaatgatattgttctatatcttcacctaattcttcccgccatgcagctctgcctctcgtttccgccactataccatcaaccccgtttcctatcaccgtagcgtcaaacgaataaacgccataagtcaccggagtaataaagcagtttgccggaccgtcttcatccacagcaatcgcttctgtgtgagatatgatactgaaaggaatatacttcactatgttacctacggatatttccaaaaatccttcctttagtgaagagttttcgggtacagtgcaataaatccaatacacatcgctatcttgcggaaggttcacttcattcaccgaaaatcctcctgttcccttcacctgtaccaaattattattatctatgctataaaacaggcataagtcagatgagggtaccaaagttttcttatccgaatttaaaacgcgaacattacgagtggtaacaccactaaaatcgacattacccgtatcatcagcctgcaattcaaattttaccattgttaccggatctgtgatgccattctctatcaacttaaggtcctccctgtccgtttttaccaagtactggccgttagaagcatatccccgcgaccaattatccgaaactgttaccgtatactcgatattactccccggattttgaatggcttccagttccctatcatatcctttattctttaacttggcaatagtaaaacgataagaatgattacgtattatatccagatactcgccggtttccttatccaggaaatccagacgataatactctttattcgaaccgtccggattctggactacaagaagcaacattgcacgatttttggagaatgttttcttatcaaccttatttcctaaagcgtaaacggagtgttcatattccaaaggatagtaacttgtcaccaatcctttcgttacatccaaaggagttgtagcggaaagcaaatcatgcttttctgaactgccgctttcgttgatactaccctgatagattccccccttatactcgctatctaacgtaaaatccgaataattcagatttctccattcccaatagacctgtttaccggaaaacaaatccgtctcggcatccaccgtaacttttgcaaaacaacgggttaatagacaaacattagaggtagccttttcattccattctatccaaccgtacatcggaatagtccgcccttcactttgcagagcggaaaagcccttcatcattccttgactagtataattcctcaactgctcttcactagccattttatttataagaaaatcacctgctcctgatgcagaagaacgattagtcaggttacaaactacataaattcgttctttgtcagcgggaatgtattctttcaatgtcacagtcggcgatgcagtgccattaccgaacaaaaaagacaaatcagctttaccctcctgataatatacaggggatgaggcgtgagaatcattatatacaaacacctgtatgccactaatcttacattccgattcattcgccacgctacgtacctgtaccaattccgcatccgggatagacaagctgatgacatttttttgagaggaatcaatcatttccatttcagtgtcatcgttacaaccacctaacaacaacatattaaaagcgaagaaaaccaacagacatatcccgaacaagtattgttgtattgttattttcatttcattcatactttttagatttctaatgaattattcctttacacagcgtatcgaagcaggcactgaagtaaccaccggattatatatattatattcaaagtccatagcagtatatggatgaaagttaaacatgagcccactatgttctttgtcagcaggatgaggtgaagaacaccagtaaactccccattttcctaactttataccatcaccattaggtctataagtctccggcaaataaattagcttcgtttcatcaatccctgcattatcataataaaaggttgatccattcgcaaaataactttttatgaaatacatatccccaagtgacgctccggccggggggaatatggcgatctcacctttactcaagattttaaaaacgtcatgcggcgcaactttataaccatatggacaagggtcatacaacgattttaatgtttctttagggaaagcatcctgttccccgtccggatttccccacagatatttcagttctgttgttttcgtacaccaagattcaccccccaatcctctccttggactatacaaggaactcggagtacttatagcttgaccggcagtcactcgttcatcggaatatttatatacgccctgaccacttcttacgtcatataaaatggtacgtatgccatcataagtcaatgaacccgaaaacgggtctttacgtccccattgataatgcagcccttgaacagtgcctaaatacgctttagtagcagtagcaccaagattacggtccatcactttatagttattgcccgtgtatatcgaagtgacgaattccagtatctttggggtagccgtacaccaaaggtgccaactccacaacactttcgcatcctccgcattaggattagtcttatcataaacagctatcactgcatttccccggcttcgtcccattttcacctgaaccctgccattgactaaagcaacttgttccaccagttcatccgtgtcctgccaaagcaatttggccgataaaggatgaatattggcaccaccggcttttgtcaagatattgccacttgcgtcttcaaacttcccttcgtcaataataccgtccactccgtttcccattatggtagcagtgaaagaataagaacctgcacctctatctgctatataactattggcagtcccttccgtgtctaacggagtaaaagtatccaatgaactgacaggaatatattccacatgcacattgtcggaagaaatttctataaaaccaccttcataattggcgggaacactaccggtggtacaatagaaattcattacttgtgcggcagtgaggtcataaatgccactgttatccgccagtttatccgtttccgttattccattgcaatataactgtaaatctgttgttgatattaaatctgtcttattaggcttcaaagctctgatttgtaagcgtcccggagcatgacagtccactttcagcagtttcaccgggtcgacaatatctttaatcaaagttatttttgtcctgtctatatcaaagtcaacgcctcctacaatatcacccgtaacccctacatcttcccaatcaagcatatccgtgaatactttcacttcatcaagacttagcacttgtacgtccaccgaataaatatggttacgtttcatccgataagaatcttccgcttttacaggtatcgtgcgttctatcacccgactagctattccgtccgtcacaggaatagtcagtttcaatgatgtcacgttaatagccgggtcatactcctcttcctgttccagataattttcataaacgaataatggataaaaagtaatagcttcaccgttaatctccacttgttcatgagcaagtatatcatataagctcacttccggataatccggataatttaatgaagatgccggcagattttcaacaacagcctcattggcatgagaagagaacggagcatacttacgaatcctatctgcagcatgaatcacctgtatttttacatctcctatcatcaattcctgcggaacagtaaatgaggttgtccgaacagtagtccgtagtttggcgactccccgtaacaaatgcacggaagctttgaaatttctatttatgccgtcctcaatcactcccgtacctgacatgtagaaaggggaaaccggctgtccggagattattgcgggagtgtcttcattggcacgtacccgcaaggtgtaacccgcctccaatgtccctatatcaaacagtgtagaaaccgcatagacactatcaacatccgtaggggtcaatgtcaatgctccgtctgctgtggaacgggatgctatcacagtcccgctattcataacatccatgaaaagccgctcaaccttgttctcaccggccatcccattctctatgcttcggacaaccggttgttttcccccgggtattaccaaacggagttccatccgttccttgccgtcgggtatcatgttgtccacattgccaatatcacaatttctaatatcttccacacatgaagataataaaagcagtataaaagcaaacttatatcctattaccattttattcgtcatagatgtaacctccattttactctttcacacaacgtacagcacctgcagtcgcttcatcccaaataacactttcacccttaccgtgaatacgttctgtccaatacagacacatgttccgacacttcatatctcgaccaaggtttcctgcacgaagcataacaacctgccccaaggatcctgacagctccccagtccccccgtatctatatcctgttgcaggataataaatatcactcctaccagcaaatccgccaccatatctttcttcatagaaaacctgctccagaccagaatcttcccatggagtagatatgccatctttgccggcaggaactctccaaccatccggacaagggtcaaaaatcgttttctttccagatttcgtattccataaataaggatacttggtagagtacgaaaaccagaggagttgtgagggtgctgtataatatgccatcggattattcactgaacccggtatattattaatatccgacgtagatacactaattttagtaataggcttaatttcgccagtgacgctatacaattcttcttcaggctccgtataaagccaacccttagctggtggaaacggatctttccgcccccattgatatagaaatcccttagactcaattcctccctgcttctcatcatagttattatatgttgcccccaaattacgatccatccaagtataaccattaaactcttgttgtccctcttctaaattcggatcatagtctgtgcaccagatatgccagctccagtaaatctttccattcactttcatcgctatcactgcattgccagactgattttccgtttccacactgatataagctttatcacgtttttccgcattcataaccttcactccggaagccggcactacccctattctatctacccaaagtacttcggccgtaacctcaccatcgggaataggtgtacgttcaaattcatccatttgtgcccatgccttgtacaccccgtcagtgggaatgtgcacccttccgccgggcgataccacataacagtttgttatacgtatatcgttcacttcttctacttggggttctaacgctatccacggacacactgtcaagtttatatccaaatagactgttttttgcatgaaccggcacagtaattgataaacatgattacgctccagtttttccaaaggcgctttgccggaattatccgaatccacacccaactctatcatatcgtaatcatcaaaaccgatattcaatttattgtttttacactccatttccggaatataaaacgagtaagccagcacgcccttgtcttcaggagaagtttcttcagggatctcactgactttctttctcgataacagattgagaacggaagacgcataacttcctgttctttttggggatacgaatcctgtcttggaaactccagtcacaaccaatgtggtaggcatcaagacttcctcccagttctttgcctccttccgcatataaacatccacacgtgccacagcacggtctacacgcatgttgactgtctgcgtcgttccctccgccgcgtccactcctgccagttctccatacatgggaagacagtagtctttagtgtattccaccacattggttcttgtggataagtagtccgccatttgatactgtacgtccaccaagtcattgggatgatccacagactccaatatagcacgggtatcaaagtcaacaggttcgtttacaatggcatacaatgttttcccggtggcggctttcaccgtaaaaaccggagtagtataagtcccgtcgatagcggaaagcccttgccagtaatacatcttgtccagtgacgtgccgtcaaaaacatagatgcgtagccggctgatgcgggtttcattcgcgttcaacacttccgggtcactcgtgacacgtgtgctgatattcatgctcatccgtacttctcccggatttagcggatcaactgtctgtccactttccgtacaggaaaacaagaacaacagcaaccacgcccaccatatacagcctttatatctcatattcatcaatctttgtttatttatcagagatcttcgcctttcagccagatagtccagccgttaatcataatcttagtagaaaggaaattcaataattccgggttatagaaaaagacaatcgcatactcactctgacggtcgaggtattcctgtgccgggatattgtgcccttccattttagtaagcagcaggtaaggtatcaggtcaaccttcatcagttccttactatccgacttgcgtgtaagcgtcaggtatacctttttatgttcgagcaggcgcatggtattcatttctgccacaatgcccacatcttccactttttccagatgatacggctggtaactaatcatgtcgtcatccagcaagtcattattccagtcgtaatatccgttgtccgcacggatttcgaacaggcaatcattcatatccagttcttctcccggaccggacttttgcagaataaagcggaacttattggtaacctttatcagccggacagtttccgtctgttcctgtttgccggtaaagtttacggtctgtatctcaccataccagagaggctccaaaactttattatgtatcaaggattcttcccgtttcatttttaccgtcaaatcttccagtgtcgattttccggcaaccggttccggcatttcaaaggcatcgctcattcccgcccacgtagctatccggtattccccaattggcagttgtaactgcatacggtaactgccactgcccagagttttcccttgttcactcttcttcatgataaacgtgccatccttgtcgaatacaaacacatcgacacgattcacttgagtcgcaaaagcatcggtgaactccatgttatagtcataccggaaactaacatataactgacattccgacagtgtctcatctatggatgtgcaagaaaagagtacaagcagtaataacaggcaacttccataacttatctgccggacggcaccttttgtattcattatctttctcataatctatgggtctatttattttttctaatttcatatatggtgtggaaaagcgcctttgtgcttttctcggaataatctgctttagtggacaagtcttaaaacttgtctgtatggcaagacctgtttttatcaagtttttcatatcaaggtcttgattcacggaaataagcctccgccggctgaataaaaaatgaaaagaaagaaaaaagaaggcgtcacaagacaaactgcgctgtatcataacgccttcttataattttaattgttattttagcccgatatatcagtcattacaaatccactccctggctccaagtagtccatgggttaactgtaatatttacagagagatatgcttctttatcatcatcgtcttcacccggatttgtaggtttagtaggatctgtcttgtcaggaatccagggagtacccggttgcttcacgctgttgatagtcaatgtgtaccagttgttgcgcacaacaccatattttccatgtgccatccattcagtgatttcgtcatcatgacgaatcaggatgttatagtagcatacgcctttctggaagtattccacacctactgtttcgccggctgttgcatcaggtttggagtattcgccaccgctcttaaggtcgtccagttcggcgatagtaatagaggcaaaatcaccaccgacagtcttgccttgtgcagtggcggctttggcaatacgtgcatagaactggtcacaaagatcgattatctgttgttgtgccgcatccgatgtaccagcagccgcagcattatatactgcctgcaaatcagccaatgtcttgtaagtgacacccaaaaggcggaaccagctttcgcccacagtaaatgaattaggagtgtaaaccgcacttgctacggcagccgtagtctgtgcctgggtttgcgcgtcatgttccattgtgttctcaagacagtatttgctgtctgtcatgggagagaagtcagcaggcaaaacacctttatcagatactttcaggtagttgaactgcgacacattgaatcctgccttttcatagttcgggtcaattctataatctgcatcagcagaacctccggcaggcattactatttcagaatatgggaacatgctcttgttggttacattcaatgcccagttaccgaatgtacaagtcactccggcaggaactatgacgccggccggatttgttcctaaagaaactttagcaactatacggtctacaaaaatctttgaacggtcagtttcggctgcggctatcgcggcagcaacgtcagaaatacccgcgtcgccaaccttttttactttagcttccgccaatgctccgttagtagggtttgtattgtcgccggcattaatcatcataaagttgtcctttgatgctccaatcacttcatcaagtgtctgctccacagcaccattgatgacagaccagggagcggaagctacacaggcagccttgaacttgccgctcggattgattactgccagtactttggcggtagcggaaggaactttgaatgcttttccgtcatatcctggcttatcagcaccacctacattcaagatatagtcggttgtacccaatgtctttgtttccaagcaaacattcgacgcatcaaacaatgcgagaagcacttcgtttactttctgttcttccacactgccatggtcttttcccggagcacgtgttcccgtacttttaggcattgtcacagatacggacatataagcctccctgccgtctaccggcaactggtcttgtccgccggttgccatctcttcatcattactacatgctgccatcgccagtccgacaaacagcgttaaaaaagatttgtccaatttcattgttttaaaatttaatgaatactaaaatgttaattactaagtataagtttcagattatattattcagtttttataccttccaaacgtttcaggtacatccgcatcgcatcataatctcccatttcccatgctacgatagcggcgttgttgttagccatcctgtcactcggaaagcggtcggcaatcatccggataatcctgttgtattcgtccgaacctttgccgtagctgactgcgacctgatacatttcgttatggttcattttgtcggggcgcgtcttgattatttcccgcccttgctccacggagaacggaaccaccgtatagctgactgtatattccaccaggcgcagcttcggatatacctcttgcagtaaggcattatagatgtttccgccgtcgatagcttttatcttcgcgtcgcgtgcatccggttcgggagtctgcccgataatatcaagcactttctgcatataggaaggacggtattcgcgcaaccatgcagctagtccctcccaattctccggcaccgaacggcattctatcatactgtcgtccagcttataggcatgtttcaggttttgtaccaacgctttcgcacgttgttcggaaaggcgggcattggcgtcataattgccttccggcgatgagtagcccactatcttaatccgggcaatacgatagttatcatcttcacggatagaatcaatggacgaatggattttagccagttcggctggattattcatataatcggcaagcaatgccgactggttcactttaaaattaagatatgcgctgcgggtgaaagaacgacgtttctcctctgcctgtgccaccattatttccagattcgggcgttccactacctctttgaataaaggaagctccgcaacgggggcattacccagtgcttctccgcaacctgcgcatccctgtaattcacggaatatctcgacacgtgcttcggacatccactcctgtgccgggactgtttcgttatattctaacaacatatcccgtttcctgttaaaacgaatcatttcctgtccctctcccgcagccggttctttgccatacagactttctttccgcttgttcatgcgataacggtttctacctgcaatgcaaacagaaggcagggcaagcgtatcgctttccgaacggctgattatcaagggagtgattatcatttgtcggcgtgaaggaagccgcagtatgctgcaatccatattaaatgagacttccactttgtcatcgcttattttccgggcaacggcttgtccgatatttatctcctgggcatgggcggaaactgcgcctagcagtcccaaggtcacgtatatacagattcttttcatcattagcctattttataatgtatatgatactcactgcagcttttgtcgggccgaagtagtttttcttctcacttttctgaatggttccacatgtggcacagggatatttggaatgatccagccgcgcatatccgactccaagtacagcctccatgctccagcggttaccgagcagccactgataaccgtaggatattccgccgccccacaaatgcccctgatagcggtggcgctccatgttatcactcaaaaatgacattccgcccacattgtatttggcgtaatgtccgtgcagacccagaaaatgaccgttgaatttctcacaaagccagtagcgaagttccggctgtacgccccagtggcgcaggcgcgtttcatcatcaaacttccagggattataatttccggataaatcgagagaccatttcttgcccaaacctatttccagccccaagttcattgtagtagtagcgtcataaagcaaattagtctttactgcaaccttttgggcgtaagagttggccgtattacaaagtagtattcccaagactccgattaaacatagatatttcttcatgtcgtcttattatttataattgcttttgtttcatctctattccgtaatagagatgaaacaaaagaatacaaacaataaaaacctaattaccaatgatttatatcacataaagcacccatataacgtttcagtatcatgataaaatgaatcatagcaaacaaaacagaaaataatattctgatatataattcattaaaaatacagatactgaaacaattgtgaaacaaacagataggtaacagaccaaacaatcaaaacagttattgccatggaaacaaaacttatgaaaagcgaattgctgtacatcgaagaacacctgtcatgccaaaactacatgacaacgattgaaaccggattcaagtatcttgagttcgataagaacacaaaatttgaggaagacactacaagtaagaattatcttctattcttcctgaaaggtgatttcaccataacttgcaaccagttccacaacagactgtttcatgccggagagatgatactcatcccacgttcttcccggctgaagggaattggagaaaacggttcaagcctgctctccatgtttttcgatatgcccgaaggaaactgtgacaagctcatattgcaatctttatcagacctttgcgacaacattgaatatgacttctcaccgattagaatacactacccgctgacaccattcctcgaagtgctgacccactgtatcaagaacggaatgaattgcgctcacctgcacaccctgatgcaacgggaattcttctttctcctgcgcggattttatgaaaagcaggagattgcaaccctgcttcatcctatcatcggaaaagaaatggacttcaaggattttgtcatgcgcaaccataccaaagtggataatatagaacagctcatttcactatcaaacctgggaagaagccgttttttctccaaattcaccaaggtgttcggaatgactgccaaacaatggatgctgaaacaaaagaaccaaaggatactcgaaaaaatgaccgaaccgggagtatgtataaaagacgccgttgaagaattgggatttgattcgcagagtaactttaaccgtcactgcaaactatatttcggatgcaccgccaaacagttaatggaacgctgccagactgaaaacagccctatttatgaggataaccacgcgacgtgtacaaaatgaataaaaaattgtactttatgacaatttatattataaaaaaataagcttactttgcagcgtgaaatagttcaaaacaacaaagagattttaatataatctctattacggaatagattacaataccgcaaagataaataaaaatattatatcttctaattttcaacggattatattacaaataatcattttacttggataagtttgtaactatgctgttcacctgattaagcatggatacatcgaaatctttcaaatagacacgtgtcatttcttccgacgtgtgaccaagtccggcactaatcacagaaattggagctccatagtcacgggcaagagtagcccaagtatgtcgtgcggtgtacgtcgtcaacggaacttttatatcagctacaacagcgattttcttcaaatgacggttgatacgccctaacgccagacggtattgttggtatcccgaagcatattcaccgctgatgatcggaaagagatactcattttctgtcttgtatttatcaatcaagccctgcatctgcggagtcaccgctatgcgaatcaactgcttcgatttatgacgggaataggtcaatacaccattgcaaatatcagccttcttcaaaaggacaatatcgacaaaagccattccctgcgcataaaagctgaacagatacagatcgcgggcaaactccagttcaggttcattctccaaattcaagtccgccagattctgcatatccgtccgtgacaaagcacgtttcaccgttttcgccgggcgggtctgcgccttcgcaaacggatattcgccacgaggatgataaccgtccgttaccgcttggttatacaaagagcgcaaattgcgcagataatagcttaccgtatttccggaagagccgttactatacaggaaatcctcgtatctcctgacgaacgccgaatcgacctccgacatccggacatcggggcggcttataaattttgccaacgacgagcgggtgctcttgtaggccgcagccatccccactttcttcagttcctgcttacgctcaatctgcgcattgatatatcgcaataaataaaactgtggttttcctgtaccaaaagcactttgagccagaatatcctccactgtaaattcttcccttgtccgctcaagctgcctgatccgtgtatcaatccgattccgcatcttccgcagctcgcggttcattttcacgacctctgtagccgtaaaagtagaacctacgccattcataatcttcccttccagctcgtcaaacacctcctctttcacccggtagcctgtatacagtaacttttttctccgattgtggatcacctgaaatactaaaggataactgccattattcaatatcctgctcttgttcagcataagtttcactgatgttatcatatcttgctttttttgtttgagacgtaaaagtacgaagttcaccttacttatcagaactatttttccgcctgttacgcaagaaacaagaaatgaaataaaaagtttttccactttaagaatagttatctgataaatatagttaaaatacacgttctagtaatcagtatatttttattacatatctccaatatgcatacgcataaattagagatgtatatcatttatgatatttctttacattatacaaagactaccgctattttttcttttgaaaaatcagaatattaggcatagctttgcactatggattttagggagccgtccgttcctttaaaaggaagaggtcattcctcggtgtgcaacgggtcgttccttttaaaggaacggcccgttggttttaaaggaaaaaccggcatttgtaaccatttgaatttcaacttcttaccgaatcagaattccgtccccgtaacccatgggattttttccaacaaacacggcggaatctgccgcacgaagcggcaatcagtatacaacaaatttcaacaattcaaaattcaaatcccatggttacagtcacgtttgccatcaagccatatctggcgaggtatatgtatgtccggtacggacaaagtttagaacttctatcgcacaacaatccaccttcaaggctccccattccaatccacctctcccacctcactcccatttatcacttcctgcatcaattatctgttcctcatccgcaaggcgtctcctggaaagagacaggaaatatctgttttgttcttcctagcccaaggcagggcaagaacccggaagtttataattatttcgggcaggacagtatctttattatcgaaaaggaaattgaggtggaaatgaaagcggaactttattcgtttctgttggagaataagttcaaaaacggagtgatgtatataaagtcgatgcatgagtttgtggtaaggtatgatatggcggagtcggtggaagaggaaagtttgatgagagggtttcagaggtggagaaagaaaatgaaagaagaataaatattacttaccatatataataagccacatcatacccccaaacactaatcacggaactgtccagctagaaccgactgaacagttgacaaaagcacatgatataaagcaatactacattaaacaagtaatgtctattttcatatatactatagggtaataaggcgatataataactatttcaagaatctaatacaataaaaagttataatagtgtcattttataaattcttttaacaggaactactcatctttagaaataaaattattaactttgcatagatatatattatttatcttattataaaattgtaaatatatgggcaactctatacatccagtagtgatagacttattttcaggatgtggtggtctttctttaggactgcataaggcaggatggagaggactctttgctgttgaaaaatgtactgacgcatttgaaactttgaaatataacctcatagataataaaaccgatccacattttcaatggcctaaatggttgcccataaaaaactgggaaattgacactttattggagaactattcatttcaactttcaaatcttcgaaataagatagatttggttgctggggggccaccatgtcaaggattttcaatggcaggaagacgtaaagaagacgatgttaggaatcatttagtacactcttatataaagttcatagagttggttcatcccaaaatgttattttttgaaaatgtcaaaggatttacccaagagtttaagaagaataaagagaaaggaattgcttattctcacttagtagtagaggaattggaaaagttggggtatcgaacagcttcacaattagtaaattttggcgattatggtgtaccacaaaagcgaactcgttttattttagtaggtttatctgaaagtttctttggagctagtgctaaatgtaaagcagaactatttttcactcaattacaaaatgcccgttttgatttccttaaagcaaaagggttaagaacaggaactacacttagtgaagctatatctgatttattaatgagtaaaggtatagtaatagacaacgaatatacacactttcgttttggaaaatacaattctataccacttactgcataccaaaagttcatgcgaagtaatgtgaatataaaaggacctcaccctgacagtcatcgcttcgctaaccacaacaataacatcatacaacgatttcaattattgttagacttgacgaaaaaacgtcgttgttctaatattgacaatgaaattaaacggcattttcatattaataaacacaccatcataccacttgatggaaatcaaaaggctccaacaataactactttgccagatgattatatccactattgcgaaccacgtattttgacagtacgtgaatatgcacgtattcaatcatttcctgacgactttatttttaaagggaaatatacaacaggaggaaagttacgaacaaaagagactccacgctatactcagatcggcaatgctattccaccactattcggtgaacaagctggttgcattttagataaaatcataaataacagattatgaatttacattttataacaaatgtccaattaaaaaatatcatcggtaaagatttaatcaacaatgataatatcgctatattagaattagttaaaaacgctttcgatgcaaacgccaaaaggacagatatttcttttgtaaatctgaaaaataatgatgatctatcaatagaaaaatattcttctaggacctcccgacttattatccgggataatggtgttggaatggacataaatgacataaaaaacaaatggcttaacattgcatactccgagaaaaagaaaaagtcttatcagcataatcgcatgatggctggagcaaaaggagtaggacggttttcttgtgataggcttggagaatttctaaacctatataccaaaaaagaagaatcatcagaatttatattattgcaattaaactggcgtcaatttgaagtagatgatgaaaagaaagagattcaagatgtagtccttgaatacgaaatactttctaccacagaattagagatgagaggtatcaaaccttttaaacatggagtggtgctagaaattattaagttaagaagtcaatgggtttactgggaacagccaaagtggaatacagaaaaattggttaatctaagaacatatttagaacgtctgattaatcccaatcaggcttttgaaaaaaatgactttggaatatatcttaatgcccctgaatttgaggaagaaaataaaaatgcagaagaaaaagctaagtttataggacgaatagaaaactcagtatttgaaaaattaaattttaaggcaacaagcattgagtgtgaagttcaagataatggagccacaacactaacaacactcaaagacaaaggagaaactattttttggataaaagagaaaaatgaattttctgattttataaaagacgcaaaatgcataatattctatctcaatccctattctaaagccttttttacgaaacaaacaggcattaggcctgtcaattacggctcaatatacttgtttttaaatggatttagaataccaccatatggtgaagaaggcgatgactggttaggattagaatttaggaaacagcagggatatgcaagatttctaggcactcgcgatattgtgggacgcattgaagtattggatcgtgacgattattttagaatagtatcaagcagagaaggtcttgtagagaatgagtgttacaaaaaactaactaatggtttttttaataagacattgaaacgtcttgaaaaatatgtcgttgatggattagcatgggatagtattcctaaagatctaaatattagcgatatcgaaaaaaaaattatttcaggagctatttcagaaaatgatctgcaatacagagaagatgaaattacaaaaaaacgacgcacatactcatctattcattcaataattgcagcaaaagcaactgatgttattgaattatatgttaatgaagaactcattctgaataaaattcaagaagaaaaaatcaattcagaaagagaatttgaacaactactttctgattttgaatcaaaaaagatcgatggtgatgcattgaatagaattctacagaaaaaagccttagaaaacgaagatttacaaagacaaataaaagagctttctaaatattctactgttgacgctacaacaaaagctatcgcagaattacaatactataaaagtatagtagagaaacagactgcaacgattttagagcttcagaaaagattgagagaaatagacgaacaacataggagtgaagtttataatttacaacagcatctctcatctgccattgatgaaaagtttaaagaagcccagaaaagaaaagaggctgaagaatatgcagataaaataaaaattgaaaaagaaaaagaagttcagattgaacgtcttaaagttgaattctacaaaaaacaatcaactcctgaaacagatgcattaatacatcatgtcaaaaacaacaatagtaaaattaaacaagaaataaacaatctaatggctaatttaaatatgatgccaatagagaaaacatataagaataaactattagaatctttattcgtaattttacgactatccaataaatcattaaaggctactgacctaattctagagagcgatctttcagaagctgatattcagaagatcaatcttccgtctttcatctcgggttatctttcaaccatagatactaaactaaaggttcattataaaactaaaattgaatattttatggtttttggaagtaaactagatttagcattaatcatagataactttttagataattctgaagcgtggaaagctaaaaatatttggttctcctgttatctgcaaaatgataatatgatattaaacatatatgatgatggtgaaggattatcgcaagaattcagcaataacccaaatgagatatttcaatttagaaaaactggaaaaaataatggaactggatttggattatatttagttcaagagtcattaagaaaaatgaacgctacaataattgtggattctccagtaaacaaaacaggtatgaattttaaaattattttcaaatagatggaacaaaagcacttaataatagttgacgaacaatctcaatctgcgacattggatgctataaaaaatacacttaagaatgaaggcatagaccttgtctataaagaaatcaatcctgctaattttcaaaaacgagtaggctataacacttcttttgataaaatatcctttattgaggaactacagaatactccttttttaaaaaagttggatgcatttgcttccgattataatcttatcgagaatgaattaaacggattggatgtagtcaaaattttcgcaaagaatgtaccttcgtatcacaagaaaattcttttatattcagcaaaaattgaaaatgtgatatcagatattctactaaaaaacaaagactttgaagaacagaaaaaaaccttaaaatttttatccgaaactcctattgaatatgcaaaaaacgacgaaaagttacaacagaatttaatctctcacataaaaaaagaaaaggactttgattttgaaagggaactatgtgattggttaatgtctaacgagttaatatataaatttccaccatatgaaggaattccatgctgcaagatcggtgatatactattatctaaaaacacatcagacagtataaaactcaaacgtgatctattggaacaatttatcgcttatttatccacatttaatgaaatacccgattatgtgtaaagtatttgctatatatcctactgacaaaaaagattccactaaatttctaaataagataaacacgtttctatgcaaaaatttaggagctgattggcattgctataaaataaagttctcagatgaagaccatcaaagatgtttaaactcagcacaaagttcagcagctaagtttatcatatttatgggccatggtcgaggagacaaattattaggttcttttaacaaaaaggcagaagatttcattagtaatgatgcactaagcgaggaacttttttataaaaatgagaaatttattcatgaacaaaatattgacttttttaaaaataaaatattattctgtttctcttgtaactctaatgaaaacaagtcgaaaagtttgagtcggatcgcaattcagaagggagtaaaatcctttataggttttggtgatatgccaacagattatatagcaggaagaccttttccattaaaagccatagaaacatataaatgcattctcacaagagtgataaaaaacggcctatacattgctataaaaaaagaatacacgattgacgagtttataagattattgaaaattctagtgacaaaagaaatgcaatctattctttttacaagttctaaatacagacataaaaaagttcttttacaagaattatataaattcaaaacgaatatcaaagtttatggtaaccgatatgaaagattagtttaacactgtgtcttattcacatttcgacatttactcttacactatgaaatatctttattcgggctttccatatttcatatatccttcagccacaataggcaaactagctccctcaacatcgtaaattctaaacggtttctgcttaaaacgttccaaataagaatgattaatccaatactccacctccaaaagcgttttctctcgaaccgcagatttcagttggcattcccacacggtcatgactttccaacccattttttttaaagcttctttattatgttcatcacgctgcttgttccgttctattttcttcctccaaaaatcaacattagaatggggaatatgcccatcaacttcatgaccatgccaaaaacatccatgaataaatatcacaataccatatttacgcaacacaatatcaggcgtgcccggcaacccctttacgtttttacggtaacggtagccacgagaatataagtaacgacgaacgatccattcaggtttcgtatccttacttctgatttttgccataacgtcggaacgtttctttttatcccagatatccattatatccccttgtttacaagtacaaatataactattttgtaaacattcggagagctctatcttgccaaaataattattttctcttattttgtaaatttcctatctttcttggaaagacttgcaaaagctccagagacaaccttagaatttttaatttttttttagtttttcagttgtaaagtaaaatctctcccaattccttactatagtcctctcataagcctcgaagaaaataaagaagaaaccttctaaaaaggtcctgcttatttgttctactacctttactttttaaattggggtaacttttttatattcgctctttttccaacagcctgttggaagattcctttctttccttcgtatatattacaaacctaatatccgtaggaaaaaataaagaaaaacggtcggatgcattttaacagaacacagctaaccatttatcaaaatgaagcatacattacaactgtctcaaatcaaacgcataactataatcaatcaagctatgctgtttttcattttgacgccacgcttcttcagcatgactcatttctgaaatttcattagccttactcttctcaaaatgagctaatacacattgtaaaacctctaattcttcaactgtaaataaagactgttcaaattgctcaacagttgtaatcatacttccagaataaccatttcccaaatttataatttccttttttaatccgtccaagttctcatatatagtactataacgcacaggaacaggcccataacttatagcttggtattgtaacccgctaatacctttaccatatttcttataggaaagaaaatcagaataaaataataatttatttagttttgtttcaaaaactccttgtaatgcagatgcaaaaaagacaataatctgcttaaccttctcgggaatgacagaagcatacccattcatacttgaacgtaaagacaaatggttgtgaaatataaattcatttattttattctcaaaacaagaattatttaataacagttcctttacccttttttcaattttaagtatctcatcatttggaaactgattttgagcaagtttcagaatttccaaaaagaaatgaggctctttcaaagctgaaatcatttttccattagacacactaggcatctctccttcttcgtattttctatattggttatcgccaaaacctaaaagtttagacattcgaagtgcagatataccatataattcccgaactctttttatttcatccggaaatggtatcgcatatttctgacgatacaaattataaacttgattcatattcagttgatcaagttcagttgtagtaaactcttcatttgtatccttacatctataaaaatgatatactatctcaaaattgtcttttcgaaattcaaatgattgcttctcatgacacaatgcagcgtcaccacctgtaaacggacttttcataacttctactttttatttttgaaaggatgttctatttttctctctgccaaatgaaaggagacacagattggagaatttgctccagtacctttacttattttgatataaacctcctttttatctacggacttgccaaactcccaaagttctcccatataattcaacttatcttccgtaggacctttataatagtcctcaactgtcaaagacattattatcttttcacgcataattgccgaaatttccaaatcaagcaaagcttgcatattcttctttctatctatacgaaagataatcccgaaagccctagccttatctttaaattctttcaagaatttatcgactgtttctatatccatatctaaaatatctttatgcaaagatatgaataatgtagtataatgcaacaaatattcaactttaaagttgaaaaagaactattaaaagactatatattcaagatatattaatattagtccgaaaaattcaactcgaatctattttcctacctttgcaaaattaaacatcataagaattataaagatatgacgattccatactaaactcgaaatattttcactacattcacagcatgaaatgcagaattatactcgaactattagcaattctcttttttacaggatgttataacagagaacaaatttcccgacttgacgaggcggaagcactgttacaaaataagccggatagtgccttaacaatattacaacaactcaaatcggaaggcagccaggctgaacaggccaggtatgcgttgctttattcagaggctttagacaaaaatcatatcaaagcaacgaatgattcgctgattcgccgggcttgggagtattacaaacatcatcccaaagatttacgccgccaatgcaagactctctattattggggaaaagtcaaactgcgtgcaggagacaagccgggagcgttacgcctttacctgaaagttgaagagaaactgaaggataccaatgagccttattatgcagggcttttatacagtcagatcggtgaagtgtattatgaccagatgaactatagccgggcttatcattattttcgtgaagctcgcaataacttccggcaggctgataatactcgcgaagaaacaaaggcaactctcgatatggcagccgcaactttcaattcgaaagatatggagaaagccatgcggctctattctgccgcactcgatctggccgatgaacacaagtacgataagttagccaaagctagccttaccaatcttgcttctctctatgtggtgtcaggcaagaaacaaattccccatgacctgctgcaacgtatcgaactttctgcccggcaagatacactatacggatatcatacattagtagatgtgaatctactgaaaaaccgtatagacagcgcacgctactatctggctcttgcagaaacacattccaccgatatacgtgacatggcagacctgcaatacaccgcttatcggattgaagcgcaggccagaaacttcgagaaagcaaccgagaagatacatcattatatctatctgactgactcgctgacacgctcgaatatgcaattctccgccggtatggtggaacgtgactatttcaaggaacgctccaaattcgccgaataccggatgaagaaccgtactacctgggaaattgccgtagcaagtattatttttctaataataggggtagcatactacatcatccgtcaacgcctgcgcctgcaacgcgaacgtaccgaccgctacctgctattagcggaagaagccaacacccaatacaaaaccctgacagaacacatggaaggacagcgcaatgcggaaagccatttaaaaggtttggtagcttcacgttttgacatcattgacaaactgggaaagacttactatgaacgtgagaataccgcatcacaacaagcggccatgttccacgaagtgaaacagattatcaccgattttgcagagaacaatgcaatgttccaagaactggaacttatcgtaaatacctgccatgataatgcaatggagaagttgcggaatgattttccgtcaatgaaagaagctgacatacgactgctttgttatatttttgtaggtttctcgccacaagtaatcagtttgtttatgaaagatacggtagctaatgtatatgctcgcaagtcccggctcaaatcacgtatcaaatcggcagaaacggccaataaagagttgtttttagcacttttcggataggtgttagacctgtgttagaaatcttagaatacatctttcataatccattgaatatcaatacactttaaatcaaattgttagatttgcgagattgcatcacaacccgaatttgatgcaatcttattacttttgcattcgaaaaattagaaaaaagaaaagattatgaagaatattgttattctattaagcgccatgcttttcatggtagcatgcgaaaaaggaaacgaagaaatgaaagaagcaaaagtagtggtatccgtttatgatgagaatggaaaaattgcaacgggcgttcccgtaaaaatgtataatgaaaaggattataaggtttttgaaaaagataatttaactttgccaactgcaatcatacagacaaatgaaagtggtatggccacctttgtactgccacgagaggaatggtttgcaacgcagtcgcaacggttcctgacatttgtggtacaagaagggggcggccctgacaactatcagatatggtcttccggcaaaaccgtagaagccggaaaagccgtaaaagtagaaatacgtttaacccaattccctaactaagcctttatcacatgaagcaaactagactttatataattacaacactttgcctgcaaatggttctgggagcaatattactaagttgcagcaccgaaaatgacgaatacaagaaagattcaccttcggcagcaaatcctgttgaacccataggggcttcacttgaagatttctccatagaacaattgcccgcaaaaacaatttatgcattaggagagaatatagacttaaccggccttaacgtgacaggcaagtatgatgacgggaaacaacgccccgtaaaggttacctcggaacagatcagtggtttctcatcatctgtccctgtcgataaacaggaagtaaccataacaatagaaggaaaacagaaaagcttctccgtgcacatttctcctgtccgtgtagaaaacggagtattgacggaaatattgaaaggatacaatgaaatcatactccctaatagtgtgaaatcaattcctaaagacgcctttaggaatagccaaatagcaaaggtagtactcaatgaaggactaaaatcgattggagatatggctttcttcaattcaaccgtccaggaaattgtgtttccatcaaccttggagcagcttaaagaagacatcttctattattgctacaacctgaaaaaagcagatctaagcaagactaaaatcactaaacttcctgccagtacatttgtatatgcaggtattgaagaagtgttgttacccgtgacactaaaagaaatcggatcgcaggcattcctcaagacctctcaattgaaaaccatcgagattccggagaatgtaagcaccattggtcaggaagcattccgggaaagtggtattacgacagtgaagttacccaacggtgttacaaacatagcaagcagggctttttactactgcccggaattggcggaagtgaccacctacgggagtactttcaatgatgaccccgaagctatgatccacccctattgtcttgaaggatgtccgaaattggctcgcttcgaaatacctgaaagtattcggatattgggacagggattactgggtggtaataggaaagtgacccaattaaccattccggcaaacgtcacacagattaatttttcggctttcaataatacaggtattaaagaagtaaaggtagaagggacaacacctccgcaggtatttgaaaaagtatggtacggatttccggatgatattaccgtcattcgtgttcctgccgaatctgtggaaaaatataagaacgcaaatggttggagggatttcacaaacaagataacaacgttctaacagttctccagtttttcgattataatcgaataaagttggtttaatatcgacttttccggttataatcgaaataacttaagaaaacactatattttcgataatagccggaaaaatcagtactattagtttatctatttaaatctccccattcacccccaagccgaacagagcaaaatcgcccaggcaaggatcatccggaaagacctctgccaatgcagtcgttatctgacgggcatttttcagagaaaaagtttccgtatccgtcaacttgaaataatgtgctacccggcatacatgtgtatctaaaggaacaatcaaatctctgcgatcaaaactttcccaaatccccaaatcgacctccgaatcccgacgaatcatccaacgcaaaaacatattcagtttcttttgaggacttttggcagaaacttcaagaaatgcacataacttttccattggtattccgggatataacatcaaagcttcctccagactttcaaactgtgtataagctatatataatcgccgaaagtatccataaaaatcagcatacgacaacatccgataaaagctattggttgctcctgaaggaaaatccttctcccactggcaggacaatacatactgataaggcgaatctcccattagcccgtgcaattcgtccgctttcttcaagatctgtttgcgattgccaaaactcataatcgccgtcagcaaaccgctgacttcgatatcctgtttcagcgtataacgatggggaaactgcaccggatcgctttgtataaagtctgcgcgatgatacatctccgcacacattaaaagtttattctttatatcttcagtcatttcgagaaagtatcaagtattgaaagtacaaaaatacatattctagttggatttcctctttaagtaaatgacggattgtatccctaataaaataacaaagagatattctgccgtcatatacacagtcagagaagcatgaaaacattcacttaacagatacagataaatcaaatatacaagaatggtgattaactggaagataaaggcgagcttcgtctttcctgtaccggtaacagcattgatataaacatatccgggcagtgcaaaagcataattcaacagcataactataaaaggatagaaagctagtctcaccagattatcgttattcgtataaaatccgataacccattggttaccccaaagagccataactatcaatggaccccccacggcataacccaacctaagaactttatggcaaacgggaaaaagttccttcccctgccccgccccaattagattgctgactaatgaaccagtagtggatgcaaaagagttgacaatcacaaaaaagacggtagaaacactacgagtaatattggaaatagcaagctctgtccttcccagatgctcgatagcaacgaagaacagaaaccagggagcaacgctgacaaaagagtgaagcatactccatatagatatcctcaacaactttattaacactttcccatcataaacgaccttcagcccatatttcactttatctaccctcacccacatatataataggagtacgataaaagctccgaactctgccaaagaagaagccatcgccgccccggatatacccagattcagtttgaatatcagcagatagttaaaaggaatattgatacagatagccatgatagctgccacggacaatgctttggtcgttgttatccctaccagaaaagaccggaaagctaaaaaaggaaatgagaataacaaaccgaagctacgccaatccagataatgaatcactgcctgataaatttcatccgaagttatcaaccggcacaggatcaagggagaagccaaatggagcaataggcaaagaatgactgccatccccgacaggaaatatactccctgaaaaaatgtacgtcccgtctctttataatgttgttccccatttctccgggcaatcatcacctgcagcccgatgctgaatccgaagcccagcatataaacagctaaataatagattccggcaagcgcagaagctcccagttcgacttctcccacatgccccaggaaaatagcgtcggtaatattgattaattgttccatcagaatgctcatcatcacaggaaagttgatgagccatatttgcttatatgtataattcattgctcaacttaaaaataacacgatacggtataccacatcatagcagcacacagttccgtaaatttataaaaatggatataaaactctttggcaggcgagtagttgcctgtcggatagctgaatagccctgttagaaatgatgctattcgttgagcgtagctatatgcagagtttcataaatggatgaatattgctggtttatcaatcaattacgcaacaaagataagaaatcttattttcatatcccaatgtggtatggtattagcagattacttatagtaaagaaatgtattaaaaacattgattgcaacattaacagattgatttatacagatataccatattctaaagctaaggaatgattcttaaatatctttctcttttgaaaaaaggcatatcattttgaaaagagtagtaaccaataaataaccagataacaatgaaagtttgtaaattcgagaaaattaaagatgaggatgaaatgaagcaagtaatcaattgtatccagaaagaacatccttatgtagctgtagtccctatattggcacaattacaggagtggttacaggctatttccatcagttggtttcacgaagaagatgaagtttctcataccacagtcaatgccatcgaagcatattgctgtacccttgccaatcatctcattacagattcgcacttaaatcaggaaattaaaaaccggattctggagtgtataaagaaaatacatatacttgtagaagacaaagcagatttactgattgataaaatgataaaagcggaagtatacggattatccagcgatttattcacttattgcttacgtcaacagggtcttcgtgcccaaacattagataccggcaaacttatacagatcaacctggaaagaaagccggatatcccatatattcaagaatctatccaacaatacattgacgagaaccggaatgtagatatttttatcgccccactttccatttgcagaaatgtgtatggtgaaatagacttcatgagcgaacaacgcaatgattactatgcaacagtgcttgccaccctattcaaagcggacgaaatactgttatccacccctatcaatcatatctacgcaaaccggaattgcctgcgagaacaacattcactaacttacatagaagccgaacaactgattaacagcggagtacacctgctctacgcagattgtatcacccttgcggcacgctccaatatagttatccgcctaaccgatacacacgatctgtcaacagaacgactctatatatcttcccatgacacaggcaacagtgtcaaggccatcctctcacaggattcggctacttttgtgcgttttacctcattgaatgtattgcccggatatttgtttatgggtaagatattggaagttatcaacaaatatcaaatcaatgtcatctcaatggcctcatccaatgtatccatctcgatgatgctgacagccagccgggacaccctgcgaatcattcaaagggaactacataaatatgccgaaatggttatggacgaaaatatgtctgtaatacatatcatcggctcccttcattgggaacgcacacaagtagaaagtcatattatggatactatcaaagatatccccgtatctctcatttcttatggaggaagcgatcattgtttcacactatctgtacataccacagataaaaacagactgattagttcgctatccagacaattttttgagaggcagtgcgcagcctgattcaaagccggataaaaagagacatctgaaagccaaataaaaaaaataaagagatgaaaatagctattataggagccggacacatagggagtgcaatcgtcacttgtctggcgcaaggacatctttacaatgagaaagacattattgtctccaatccaaacattgataaactggagagactgcaagaacatttccctgcaatacacataacgaccgataaccaacaagccatatcggaagccgaagtaatcgtcctcgccatcaatccctggaaagtagatgaagtattgtctcctctacgtttctcacgtacacaaatcctcgtatctctcgtgtccggagtatgtatctcccacctggctcatttgacagaagccgagatgcctatctttcgggcagttcccaatatggccattacagaacgttccagcctcactttgatagcttcccgcggaaccgataaagaatatcagcaattaataaaacagatatttgaagaaggaggaaaatgcctgttcctgcaagagaaacaactagataccacttccgcattaacctccagcggaatagctttcgccttaaaatatatgcaagcggttatgcaggcagggattgagctaggaattcccggcaaggatgccatgcaaatggcagcgtatagcatggaaggagcgacagaactgattctgaatcataacactcatccattgctggaaatagagaaagtaaccactccgggtggaaccactataaaaggattgaacgaactggagcacaaaggcttcacttcttctattattcaagccatcaaaagcagtgccacaactttgattgataaagaggaagaagatgtaaaaatcttccggtagtccttatggtatggtttctcaagtcctttttgcctattttgaaatgctatatatcccaaagacagcataaaaggacttaagaaaatatatgcttagattttatattcctctatcttccggtacagggtggtaagtccgattttcaacaaacgggcagcttccgttttattcccctttgtatattccaacacacgtgcaatatgtctgcgttccattgcggccaactcaaaactgcctacactatcatccgaacattcataatgagtgttttggatttccaaaggaagatcacaaatatccagtcgccccccttcacacacaatcaggctacgctcaatcacatttctcaattcacggatgttccctttccacggctgttgttccagcgcttccagaaaagcgggagtcatctcattgatggcatacgaaagtttttcggagaaacttttggcaaaagcagttgcaagaattctgatatcaccggtacgttcacgaagcgaaggaagatgcacctgaaaaaccgaaagacgataaaacaagtcttcacggaaatgtcctgctttgatctcctcctgcaggttgcggttggtagcagcaatgatacgcacattgactcttgtcggcttggtatcaccgatctttatatattctcccgtttcaaggatacgcagtaactttgcctgcagttcgaaagccatctctccgatttcatccagaaagatcgttccgttattagcttcttcaaaaagtcctttcttatccttcagcgcaccggtaaacgagccagccttatgtccgaacatctcgctttcgagcagttctttactgaaagacgaacagttgaccgccacaaaattctgtttgctccgtttactactataatgtatagcttgcgcaaagacttcctttcctgttcctgtttcccccgtcagtaatacgggaacatctgtcacagacactttctgcgccagagatacagcctctttcaacacctttgactcacccagaatagaatcgaacgagtacatctgcccgactttcttttccagtttttccaaacggacattcatctttgctttctccacggcacggctgattaaaggaataatcttgttattatcatctcctttcgttatataatcaaatgcaccgtttttaatagcctgcaccccgtcgggaatattgccgtgagcagtaagaagaatcacctctacattgggagctattttcttgatgttcaacaccagatctactccgtttccatcaggaagaaaaacatcgcataaagctacgtcgggcgattgaatttccagttgtttgagggcagctttgcaatcacctgcctgacacacttcatagccctcaagttccagcatacgagctaaaaggctgcgaatctggacttcatcgtcaataataagaattttattcatacaatttatctacattaaatagaagaatgaaaaacagggtgcgcaaatatagtttttttatctgaatccatgaacatttcttccatacagtttgttctttccacaggaaactatttacgctataaacagatgaaaataattattattgggggagttgcaggaggagccaccactgctgcccgaatcagacgagtagatgaaacagctgaaattgtccttttagaaaaaggaaagtacatatcatacgccaattgtggcctaccctattatatagggggagtgatagaggaacgggataaattgttcgtgcaaacgcccgaagccttttctacacgctttcgcgtagatgtacgtacagaaaacgaagcgattttcattgaccggaaaagaaagacagtgaccatccggcaaagcagtgaagatacttatgaagagaactatgataagttagtcatatctaccggagcctctccggtacgcccccctcttcccggaatcgacctaagtggaattttcacactaagaaatgtcaccgacacagatcggatcaaagaatatatcaagagccacgccccacgaaaagccgttgtcgtaggagccggatttatcggccttgaaatggcggaaaacttacatgcacagggagcgaaagtatcgattgtggaaatgggcaatcaagtgatggcccctattgatttttcgatggcatcacttgttcatcaacatctgatggataaaggagtaaacctctatttggagcaagctgtcgcctcttttagccgggatggaagaggattgaaagttactttcaagaatggccagtcaatctctgccgacatcgttattctatctatcggcgtacgtccggaaaccaatctggcacgggctgccgaactgactatcggtcctgcaggaggtatcgctgtaaacgattacctgcaaacctctgacgagtctatttatgccatcggtgacgcgatcgagttccgccacccgatcacgggcaaaccctggctcaactatctcgccggacccgccaaccgtcagggacgcatcgttgcggacaatgtcctcggagcaaagattccttacgaaggctctatcggtacttcaatcgcaaaggttttcgacatgaccgttgcttcaaccggcttacccggcaagcgtctgcgtcaggaagagatagactatatgtcgtctaccattcatcccgcttcccatgccggttactatccggatgccatgccgatgagcattaaaatcactttcgataaaaagacaggaagattgtatggcggacaaatcgttggttacgatggggtggacaaacggattgacgaactcgcacttgtcatcaagcacgagggaacaatctacgatctgatgaaagttgaacaagcgtatgctcctccgttctcttcggccaaagatccggtagcactggcaggatatgtagctgaagatatcatcacaggcaaaaacaatcctgtgtattggagagaattgcgagacattgaaatggaaaataagttcctattggatgtccgcaccccggatgaattttcattgggtagcttaccgggtgccgtgaatattccgttggatgaacttcgcgaccggttggcagaattaccgaaagataaaatgatttatacattttgtgcagtcgggttacgggggtatcttgcttaccgtatactgacacaacacggatttgacaaggtacgtaatctctcgggaggattaaagacttatcgggctgccactactcccatcatcatacgggaagaaaatggaaacgaaatagacgaatcacccatacaaaaggaaaccgcttcccaaaccagtcaacccaacgtttctacagctcccatcactgctgcagctgatgcttccgctacctctgccaaaacagtccgggtggatgcctgcgggttacagtgtcccggtccgattctgaaaatgaagaaaacaatggatacactggtttcaggcgaacgggtggaaatcacctctaccgatccgggttttccgcgcgacgccgccgcatggtgcagttcgacgggtaatcaattgatttcgaaagatacctccggaggaaaatctattgttgtcatagaaaaaggagaaccaaaatcgtgcaatattgttacttcatgtgagggcaaaggaaaaaccttcatcatgttcagtgatgatttggataaagccttggctacttttgtactggcaaacggcgcagcggctacaggacaaaaagtcaccatcttctttactttctggggactgaacgttatcaagaagttgcacaaaccggaaaccgaaaaggatattttcggaaaaatgtttggtatgatgctgccttccagctccaagaaactgaaactttctaagatgagcatgggcggaatgggcggaaaaatgatgcggtatatcatgaacaagaaagggattgattcactggaatctttgcgccggcaagctttggaaaacggtgtggaatttatcgcttgccagatgtcaatggatgtgatgggagtaaaacaagaagaacttctggatgaggtgaccattggcggcgtagcaacgtatatggaacgggcggataacgcaaacgttaatctatttatttaaaaaatgaactaataaaatattcaaataaggtatgaaaacaatatgtgcaatgcgtgatgtattcaaagcaatgggaaactttgaaacagcatttgaaaaaatgtaccagataacgctaaatgaagcaatgatattgtgtgccctcaaagaggcatcggagaaagtgacggctaccaatctgtccaagcaaaccgagctaagcccctcacacacatccaaaatgctgcgaatactggaggaaaaagggctgatcgtccggtcgctcggaagtgaagaccggagacagatgtacttccacctgacccatacgggcaagcaacgagtaaatgaactggaacttgataaggtagagatacccgatctacttaaacccctgtttaaataaacggattttcaaacaattatctgtaaataatgaacggtgagcaaactccctgataatggggcagagtgctcaccgtttttctttaaacagggcaaaagatatatgttaattttccggcaaaagaaatttccatctgaacctttttccacctttcttgttgtttctatcaaaagcccaaggtacctgggcgcgatttttatataacctaaacattataaaagatatgaagaaattaattcctattttattggcggtctttgcactcgcttcatgtgaaaaagacccggacatgggtaagctggatgacaattatctggtatacactaactatgacaagaaagccgatttcaaagttcctacattctatctggcaccccagattctggtgattagtgacagtaaagaaccggaatatctcgaaggtgaaggcgcagaacaaattctggctgcttatacagacaatatggtagccagaggctacgaagcagcagcagaccaagaaagtgcagatcttggtatccaagtgagctacatcgcaagtacttattatttcaccagctacacacaacctgaatggtggtggggttatcccggatactggggacctggctactggggtggcaactggggtggtggatggtactacccgtacgctgtaacttatagttatagcaccaactccttcctgacagaaatggtgaacttgaaagccgaacagggagacagtaaaaaactacctgttgtatggacaagttatctgaccggatttgaaactggttccaaagctatcaaccgtactcttgcagtagaagctgtcaaccaatcatttacacagtcaccttatcttactaacaaataatcaactacaactgttatgaaaacaagaaaaaatatatacttcaaggtagtagccttggcggctattgccatcgccttcgccatgccggctaaggcacagctatcagacaatggatatgcgaatatcgactggcagttcaatgctccgctaagtaatcactttgcagataaagcaagcggttggggtatgaactttgaaggtggttatttcgtgactcctaacattggcttgggacttttcctcaactatcacagcaaccacgaatatgtaggtcgcgaaaccttccagatgggtgccggtgaagtgactaccgatcagcaacataccattttccaattgcctttcggtgccgctgcacgttaccaatggaatcgcggtggatctttccaaccttatgtcagtgctaaattaggtgctgaatatgctaaaatccgctctaatttcagcatgttggaagcaagagaaaacagttggggattctatgcttctcctgaagtaggtatcaatgtattcccatgggtttacggaccgggcttgcactttgctttgtactacagctatggtaccaacaaagctgatgtactgcattacagtgtagatggattgagcaacttcggtttccgcctgggtgtatcgttctaaaaagaactgcaactatcagaatattacgttaataataaaaaaggtaaaaggtagcttttaatatagataccttttacctttctttttttattttttcttcatcgcatcataaatagctccctgtattcgctcacgaatgtgcagctggttcaatttgcggttcgttacgtccggataaatccggttgctaaggaatacataaaccagttcattgaccgggtccacccaggcacatgtaccggtaaatccggtatggccatacacttcggcaggtgcggcaggcgcacaatttcctttcttcgaatcgtctgcatccggcttgtcaaagcctaagccacgccggctgatcttcgaggtttcagtagtaaacagctggcaagtttctttgctaagataacgttgtccatctatttctccaccattcagcaacatctgataaacgcgggctacatcacgggcagtagagaaaagtccggcatttccagccaatccgccaaagaaagcggaagcctcatcatgtacaaatcccagcaaagtctctttacgcaagaaacggtctttattagaaggaacaatttccgatttggcaaagcggcgtaaaggcaggtaacctgtatgttccaaccccatcggctcataaaactcacgttgcaaataggcttccataggcataccggccagttgttccaccaacattcccaagagtataaatccgacatcactatatacatagcgcttctgctttaacggagcttctgcaattttctcttctatcacctttcggaaagaacggtttaaccacaaactgtcacagatctgaacagtataatcaccggtcttgaccggagaaatatattcactcttgaatttgaatttcggattcgcccacgtagtcgtaccaatctgtaccggatggtggacatctttacgtgcgctgaacaatcttccgtcatagctatccttatcgatggcttcctgataaaaaggaatccaggaaggtaaaccggactgatgatacagaatttcctgaatcgttatatctttcttatcagtacgttgcaagaacggcaaatgatccgaaattttatctgtcagattaaaacgtcccttatcgtagagtttcataatggcaagcaaggtacccgtcgtttttgaaagggaagccagatcgtagatattcgtagattcgacacgaggacttcctttacccgtataagtaccgaaagccttgtcgaacataatatgaccgtttttcagtaccaccacctggcaaccaggataggctccctgacgaataccatccaatgcaatggaatcaatccgttttagatgagcagaggaaagcccgtattcttccggaacgaaatgcaacggcgttttaggggtaatagtcactcctgctcccgttgggaacagttctcccagacttgccgacaactgtccgtctgcagatgccttggcaaatagcacatctgccacctggcgctgcacgtcactactatagctatgtcccagcaccaccgccgaagcatgagccaccgcgcgctgaatctgcaacatcatcttcccgggagtaaaaaacagataaatggccgggctttcgggaacaaacttagcaaagaaaggctgataaggagccagccgctgttcactgacggctacaataatccgtttataggtagacaaagaatcacgcaaccgctgattttcctcttccgtctgattggcacgaagggaaaaacgagccaaagacgtatagcgggaaagttgtttcgccaacgcatcagtttctccgggatctcctacctcgagcaatgcaatcgtctgctctttgtctgtatgcaaagggagaatatgattcttgttgttcagaactgttattgccgctaaattcaaccggcgaaccaaatcacgcgtttgcggactgttaatccgttgttccagaccggataattgtacatacgactttttcttcagtcccaacacatatttataagtcaagaccttacgacatttgctttcaatatcttcgcgggtcaactctcctttttcaatggcttccagtacggccggtatctcttccttcaagtttcggggagacaataccatgtcattaccagctttcaaagcctgcaaactgacatttccatttcccgccactcctttcatggcaagcgcatccgtaaatatgagtcctttgaacgccaactcatctgtcagcaaatcatatacgacattgcgggacaaggaagacggaagtccaccaatcggttctatcaccggaacttgcaaatgtcctaccatcataccgcccaatccggcacggatggcttctttaaaaggataaagttccacactgtccagacgctcacgagtgaaaggaagtaccggaagcgccttatgcgaatcaacatcggtatctccatgtccgggaaaatgtttgcacacagataaaacccctccgctttccaaaccggaagcataagcgataaccttatcagccacctgtatcggatcttctccaaaagaacgggtattgattacgggattttcaggatttatattcacgtccgccaccggagcaaagttgacctgtactccaatctgtcggcattgacgagcaacttcacgcccgtattcatagagcagcttgttgtcacggatacatcccaataccatattccgtggaaaaacaggcataccacgcaaacgcatggccagcccccattctccatcaaaggtaatcatcaaagggacttttgcctgccgttgcgcccggtttgtcagttcaacctgattttgcatcttcccaccggaaaagagaagtccgcccactttataggtgtcgattacttcgcgcaacagttccaggtttcgtttggtatctaccggggcaatggtatagatgaacaactgccctaccttttctttaaaggaaagcttatccataaccgaatcaacccagtgccggcagtctttgtcctgaagggctttatacaccagcagaggttcaacggttgtagcattctgcgccggacttgaaaccgtgccggccgcaataaggaataaaagcgttgctattgaggggattatcttcatttatgttttaaagtcaaatcgagacggcctacacgaacaccattttttcccgtgtgcataacaggcacctcttttccgtccatattcaagtatattttgggccctttcataaatgtatgagagtgcccgcccagaatcacgtcgatattgcgtgttccggcaaccagatgttcatccatttgaatgcccagatgagacaggcatactaccaaatcacaaccttcttcgtctttcaacaaagcagctatttcgttggatacgcggacaggatcttcataaacgactccttcgcatttattagcctgaatcatcccttcgggttgggttccaaggccaaacacaccaattctcaaaccatatttctcaagaacgacgtagggtttaactatatctttcaataccgtagcatccagattatagttggcacaaacaaccgggaaattagccatcttgaaaatacgttccatattatccacatcgaaatcaaactcatggttaccgatagtcatagcatcgtaacccatttcattcattagtttaacttccacttctccgcggaacatattataataaggtgttccctgagaaatatctccgcagtcgaaaagcagcacattcttatgctccttgcggaactgttcgagaaaaacagcccggcgaagaaaaccacctttattatagtattcgtcccccttctgattgacaggttcgatacgactatgcacatcgcttgtttgtaaaataatcacttctttggtatccttatcctgcgcaaaaattgagaaagtaaagctcaatgcaagacataacaggaataatatctgaattcttttcatattcaatatttttagattctcctttttattttatgctaatacgtccatccagtttggaggtaatcgctttgccttcggcagtctgtttgcgtacataatcaagaaatagtccgcgtaaggttgcgtcttcggggcatactctcttttctgcctgcaggaaagcatccatccgtccatttccatctgccagatagtcgatagtggccaccgtgtaaagctggtcatcctttagtggtttttcaccgacaaaggcgttcagcaactttccatttttggtgatttcaaggcggataccgctcactccttctccgtgcagagatgcaatcgcttcaaaaagacgtctcaagtctgttcctttcatagtcagtacgcaaagagaattctcaaaaggaagaatttcaaacacatcgcctaccgtgatatctccttcgggcaagatattacgcaagccgcccatatttaccaatcccatatcagcaggtttccccaacacctgaacagccgcttgctgcaaaacacctgcaacaaggttggaaagtaaactttcgggacctcctttgtccattttcatcgcactggtgccgatgacttcatacatcatcgcatccaccttttccttataaggctttaagatttcggcagctttcgcgttgggatgggtgtcccaaacagaatcaatcgttatcatgctgccctctactttagttatttcgtactgagccgtagtctcgcgtgcggtccggcaggaagtaaacaggaagcctcctgccaacgctgccaccatcagatactttgcataagtctgtttcatgttcgctatttttagatatgctacaaatatacaaaaacatttggctatctggcaaataattcgttactttgcaccgctttcgcgcaatcgctgtcaagagaagagatacttggtatgttgcgttgtaacgatgaaacaatttaataataacaacaatggatttaattaaaattgcagaagaagcatttgctaccggaaaacagcacccgagcttcaaagcaggagacactgtaacagtagcatatcgtattatcgagggtaacaaagaacgtgtacagttgtaccgtggtgttgttatcaaaatcgccggtcacggagacaagaaacgttttactgtacgtaaaatgtcaggaactataggcgtagaaagaattttcccaatcgaatcaccggctatcgatagcatcgaagtgaacaaggtaggtaaagttcgtcgcgctaaattgtactacctgcgcgctcttactggtaagaaagctagaatcaaagaaaaaagagctaactaataagccgaacttttcgattcgaaataaaaaagggaacttcattatgaggttcccttttttattgtatattttctcaaacattctcatgcctatgagaatattttctcactccggtgagaataaccctttgtctgaataagccgtacacgtcagaaaggactaaataaaacaaagccccgaaagtcataaactcccgaggcttcattacctttattataataatgaaatgttattctttcaaatctttcagttcccaagccaatgcactggcgcccagtacagcagcatcagaatccttcaattcggaaacgagcagtttagtcttgcctttatagatattcaggatattatcatcaattgatttctgaattggtttcatgatatagtcaccggacttagccaaaccaccaaacaatacaattgcttcagggctggagaatgcaatagcatctgccagtgcttcacccaagatgttacctgtaaagttaaagatttcctgtgccagtttatcaccttgtacagctgcatcatacacatcttttgaagtgatgttttctgcaggaatgttacgaagcaagctagcatccgtacgggcagcaaggaattcgcgagctgtgcgagctacaccggtagccgaacagtaagtttccagacatcccttacggccacaaccgcaaagacgaccatcgcgacgggcgataacgtgtcccaattcacctgcaaaaccgtcatgaccatacaccatctgaccgttgataacgataccgctacccacaccagtacccagtgtaatcatgataaagtctttcataccacgggcagcaccgtaagtcatttcaccgatagcagcagcgtttgcgtcgtttgtcaaagcagtggggatacccagtctttcttcaaacatggcagccaacggaagaattcccttccaaggcaggttcggagcaaattcaatcgttcccgtgtagtagttgccattcggagcaccgataccaatacctctgattttatcaacaccaccattagcaataatcaatggaagcagacttttacacacttcatcagcgtattcttctactgtagggtaaccagatgttttgattgaactgctggcaataatagttccgcgtgcgtctacaattccaaagacggtattcgttccgcctatgtcaatacctactacgtagggtttttccatgtttgaattcatgatacttttatttaaaagggttagttaatcattaagtttactgcacacaaattacgtaaagaagattgagtctacaaaatgttttttgaaaaaagttcaacctgtttgcaacttttcgtatctttcgcacgtctaatagtagaaaattatcagaaaacagaaactaaataaagaaaattgtgatacaactaacgaatatcaacaagacctacaacaacggagcgcctctccatgtacttaaaggtatcaatctcaacattgaacagggagaatttgtttctatcatgggagcatccgggtctgggaaatcaactttactcaacatattgggaatcctcgacaactacgataccggagattattacctgaacaacgtacttatcaagaacttgagcgaaaccaaagctgccgaataccggaaccgtatgatcggatttatcttccagtcattcaatctgatttcctttaaagatgccgtagagaatgtagcacttcctttattttaccagggaataagtcgcaaaaaacgaaatgcgcttgccttggaatatctcgaccgcctgggtttaaaagactgggcacatcacatgccgaacgaaatgagtggcggtcagaaacaacgtgtagccattgcacgagctttaatcacccaaccacaaatcattctggcagatgaaccaacaggagctttagatagcaaaacttctgtggaagtgatgcagattctgaaagatcttcataaactgggaatgacgattgtcgttgtcacccacgaaagtggagtcgccaaccagacagacaagattatacatatcaaagatggaatcatcgaacgtattgaagataatatcgaccatgacgcttctcctttcggaaaagacggtatcatgaaataatctaaaatccaccactatacaaacattatcatgattgacatctggcaagaaatatatagtaccatcaaacgcaacaagctaagaacttttctcacaggatttgccgtggcatggggaatctttatgcttatcgtcctactaggtgcaggcaacggactgatccacgcattcgagcaatcggcttccgaacgtgccatgaactccatcaagatttttccgggatggaccagtaaatcatacgacggactgaaagaaggaagacgggtgcaactggacaataaagacatggatgctaccagtcattatttcccgaatcatgtcatcaaggccggagcaaccgtgtggcagggaggcgttaatcttagtttcggacaagaatacgtcagcctgaacctttccggcgtatatcccaatcatacagaggtagaagtcgtgaagcttttcgaaggacgttttatcaatgaaatcgatatcaagaaacgccggaaagttattgtgcttcataagaaaacagcagaaatcctttttaacaagactcataccgagccaatcggacagtttgtcaacgccggaaatgtggtttatcaggtagtaggtctttataatgataaaggagatagcggagacagcgatgcctacattccttttaccactctgcaaacgatttataataaaggagacaaactgaataacctggtcatgactaccaaaaatctggaaacagtagaggccaatgaggcttttgaagcccattaccgcaaagtattgggagccaaccatcggtttgacccaacggaccacagtgctatctggatatggaaccggtttaccaactatctgcaacagcagaaaggttcgggcatgctgcgtatcgccatctgggtaatcggcatctttacgttacttagcggaatcgttggagtttccaacatcatgctgattaccgtcaaagaacgtacccgcgagtttggtattcgtaaggctttgggagccaaaccgctttccattctctggttgattatcgtagagagcgtcaccatcaccaccatattcggatatatcggcatggtagccggtatcggagtgaccgaatggatgaacagcgctttcggcaatcagaccatggacaccggaatgtggacggaaaccgttttcctgaatccgacagtagatataagaatcgccatacaggctacactcacattaataatagctggtacgttagccggattattccctgcccgaaaagcagttagcatccgaccgatcgaagcacttagagcagattaagactatgagaatagacatggatacctgtgaggaaatcctcattaccattacaagaaataaaacgagaagcctgctgactgcattcggtgttttctggggaatctttatgctcgtagcccttatcggcggcgggcaaggattggaggacatgatgaaaaagaactttgaaggatttgccaccaattctggtttccttgtctcgcaaagaacgggcgaggcttacaaaggcttccgcaaagggagatggtggaatctggaatctaccgacattgaccgtcttcgctcccaagtgaaagaggtggagatcattactccgtccgtagcccgttggggttccaaagccgtatacgaagataagaaatatgattgtagcgtgaaaggattgtatccggattatctccacattgaatcacaggaaatggcatacggcaggttcatcaatgaggtggatataaaggaagcacgcaaagtatgtgtcatcggaaaacgaatttatgaaagtcttttcaaaccgggagaagacccgtgtggcaaatatgtaagagtagatggcatttattatcaagtgattggcatgtcttcttccgaaggggacatgaatatacagggacgggcttcggaggccgtcactcttcctttcactacgatgcagcaaacatataatctgggaggacgaattgatgtgatctgtttcactgcgaagcatggagtcaaagtgtctgaaatacaacccaaaatggaacaggtcattaaagccgcacattatatctccccggatgacaaacaggctgttatgtgcctgaatgccgaagctatgttctctatggtcgataacctgtttaccggtatcaacatacttgtttggatggtaggattgggaactttgctggcaggtgccatcggagtatccaatattatgatggtgaccgttaaagaacgtaccactgaaatcggtatccgccgggcgatcggtgcacgaccgaaagatattctgcaacaaattctatcagagagtatggtacttaccaccattgcaggaatgtgtggaatatcctttgccgtcatggtgttgcaacttgtagagatgggagccaacgctgacggaggggacacccgttttcaagttactttcggactggcaatcggtacttgtgcccttctaatcgcactgggaatgttggcaggtctggcacctgcttaccgggccatggctatcaaaccgattgaggcgattcgggatgaataaggaagtggaacagttatctggatatgtgaggagtttagtttcaatcatcaatcgtaaataataaaattataaataaaatcatgaaaaagtatctgaaaatcacattattggtagtcattgctatcattcttgtcggaacattcgtattcctttatcagaaatccaagcctaaggtaatcacttacgaaacagttagaccggaaatgactgacctccaaaaaactacagtagctaccggaaaggtggaaccgagagacgaaattttaatcaaaccgcaaatttcgggtattatcgacgaagtatataaagaagccggacaagctgtaagaaaaggggaagttattgccaaagtaaaagtaatccctgaactcggacaactgaattctgcagaaagccgtgtgcgcctggcagaaattaatgcaacccaggcagaaacggatttcgcccgtgtgaagaagttgtatgacggtcagttaattagccgggaggaatacgagaaaagtgaagtggctttgaaacaggctcgcgaagagagacagacggccaaagacaatctggaaatcgtaaaagaaggaattaccaaaaacagtgcctctttcagtagcacgatgattcgctctaccattgacgggttaatcctggacgtacctgtaaaagctggtaattcggtgattatgagtaatacgttcaatgatggaaccacgattgctacggtagccaacatgaacgatatgattttccgcggtaatattgatgaaacagaagtgggacgtatccacgaacaaatgccaatcaagctgaccatcggagctttacaaaatctgactttcaatgccattctggaatatatctctccgaaaggggtggaaaccaatggagccaaccagtttgaaatcaaggctgcgattaccattccggattctgttcagattcgttccggatattcggctaatgcggaaatcgtattacaaaaagccaatcaggtattggcagtgcccgaaagcactgttgaatttagtggtgactctacatttgtgtacatcatgacagattcagtgcccgaacaaaagttccagcgtacacaggtgactgccggtatgagtgatggaatcaagatagaaatcaagaaaggggtaaccgttcaggacaaaatacgtggtgcagagaaaaaagataaataattgaatccgatgaaaataattcgtaaaaccatatcagcccttctgcttgccggagtcggaatcacctccattcaggcacagaacaactcttcgcaagcatggacgctgcggcaatgtatcgactatgccattgagcataatatagaaatccgtcaatcggccaataatgtcgaagcaggcaaagtgagtgtaaacaccactaaatgggcacgccttccgaatttgagcggtagtgccagccaaaactggagttggggccgtactgcttctccgatagacaactcgtatagtgacatcaacagcgccaataccagtttcagcttgggaacaaacgtacctatatttaccggtttgcaattgcccaaccaatattcacttgccaaactggatttaaaagctgccatagaagatttgaataaagccagagaagatattgcaatcaatgtcacttcggcttatttacaggttttattcaatcaagaattaagtaagattgctcataatcaggtcgatttaagcaaagaccagttaaaacgtattcaaggtcttcagggagtgggtaaggcatcctcttctgaagtggcggaggcacaagcccgtgtcgcacaggatgaaatgactgctgtacaatcagacaatacgtacaaactatccttactggatctcacccaactcttggaattacccacgcctgaaggatttgtactcgaaagccctaaggaagaattagagttcgaatctctcactccgccggatgacatatatacacaggcacttacttacaaaccaagcattaaggctgcggaatatcgtttgcaaggtagtcttaatagtattcgtattgcccaaagtgcgttttatccacaactctctttcagtgccggtctgggaagtaattattatacggttagcggaagatcagagagcagcttcggcagtcagatgaaaaacaatctgaataaatatataggatttaatttgagcgtgccaatcttcaaccgttttgccacaagaaaccgggtacgcacggctcgtttgcaacaaatagatttatccttgaagttggataacagtaaaaaagttctctataaagaaattcagcaagcctggtacaatgctctggcagcagagagtaaatacaactccagtgaagtggcagtaaaagccaacgaagaatctttccgcctgatgagtgagaagttcaataacggcaaagttacctttgtggaatacaatgaagccaaacttaatctgacgaaagctctttcggataagttgcaggcaaaatatgactacctgttccggactaaaattctggatttctacaaaggacaggtcattgaataaaaaagaaataaagttgagtttagtatagtagttccttaaaacatatccgttggttcattcgttattatagaaagaactaacggatatgaagtattttatcgtcctagtgattataatgattagtaatacatttttaggagttgctaaaccaatgaagaatcaagcagaaatctattttgcgggaggatgtttctggggaacagaacatttcctgaaacaaattcgaggagtagaaagtactcaggtaggatatgccaacagtaatgttgccaatccgagttatgaacaggtctgttccggaaaaaccaatgctgccgaaacagtaaaggtggtttatgatccgaaaacggtagatttgaatttactgctcgatctatatttcaagacaatagatcctaccagcctcaaccggcaaggtaatgaccggggaacacagtatagaaccggaatttattatgtagataaagaagatctccctgtcatcaagcaggcaattcaattattatccgcacaatataaaactcctattgtcctagaagtaaagccattgactaatttctatccggcagagacttaccaccaggactatctggataaaaatccgggtggatactgccatatcaatcctgctttattcgaaatggcacgcaaagcgaatgcgccgaaagctaaagtgtatcaaaaagcggatgatgcaacccttcgtaagaaactctcggcggaacaatatgccgtaacccaaaagaatgccaccgaaccagctttccacaatgaatactggaatgagcatcgtcccggcatttatgtagatattactaccggagaacctctgtttgtttctactgacaagttcgattcaggttgcgggtggccaagcttttcccaaccaattcaaaaagatctgatcgcagaaaagaaagatacttcacacggcatgatacgtacggaagtacgcagtaaaaccggagatgctcatttgggacacgtattcacagatgggccgaaagagaaaggtggattacgttattgcatcaatagcgcttcacttcgttttatcccgaaagataaaatgaaagaggaaggttatggagaatatctaccactcgttaaataaatattgaagagttacaaaagctaatcataactgttcatcagataaacagaacggtggattatcccataaggaaatccaccgtttttaatgtagttaaattaaaagagagagaaggagtttcacaactccgatttatttttatctgctggcagtcagcagagttgcttcattagttgccggaacagacacattcatagcccagctggaaccggattcttcaatccatttatcattccatttgtagttcatataagcaaccggcatattagcgtcattcagttcataaacactcttttcaacagatgcgtcgtaagctctgtgagagtcattccaacgtgcgtataccaaagtgatttcattagatgaataagtataatcaatcttgaagtacggtatccatttttcaatagaagcatcccatttgaaagcttctttggaggatattctcttctgatcgtcataagtaaaatcatatttcatgtggcgatagagagaaccatcgagtctgtaaatcactttcgatactacgagatcatctactttttcttcattagtaatgaagttattaccctgtgccttcactgttgcattagcgattcctgcaaataccatagcaactaaaacgatcattctgaataatactgtagtcttcataattgtatattttttatttgttcaacattctgtttttattcttctgtttattagacggatcaagcgtctcaaacggttgcaaccttctgaagtttttttcatttttcttcgttgtccgcttgcgactatagagatgcaacgagcgtgccaaaacgataactaactaataatcaaggaaatcataaaacagaacggtgtacgaaaacgaacagttgtacgcttaaaagcgaacaactaaccatttttttcgcattttcttctttctactgatgaatataactctaaaaatgggaaaatactccgcttgttgcccgaattattatctacctttgcagcgattatcatatcaagaaaaagaagatggaaacgtccagcaaaaaaagaattatcattctatcggctaccagtatcttgcttaccagccttatttgtctctttgcattccgcaatgtcattttatgccatatcgttgacaaacgagctacacgtgccgaacaaacatacggtctacaaattcattatcaggagttacgaatgaaaggctacaatgaagtggctttacaaggactttctattgttcccaaccaacgggataccctcctgacattacaatccgtcaatgtaaaactaagtttttgggaattgctaaaaggagaaatcgaagtacggaatgtgcttatgaatggccttgcaatcaacttcatcaagcatgatagcatagctaactacgatttcctgttctttaaacggcaacaagaagcagaactccaacctgtcatagaaagtgactatgccaaccgtattgaccggatattaaacctcatttacggtttcctgcctgaaaacgggcaactcaggcaaatcaatataaccgaacgtaaagatagtaatttcgttgcagtcaacattccttcttttattattgagaacaatcatttccaatcaaccattcagataaaagaagatacacttcctcaacaactatgggaagcgaccggcgaactaaacagaagagactatacattaaaagcatctctctttgccccggaaaaaagaaaaatctcactaccttatattacccgccgttttggagcagaagtcactttcgacaccctatcttataatatgactaaagataagcgtgcatccaatcaactgctcctcaaaggaaaagcgagagtgaacggacttgacgtatttcataaagctctctctcctgaagtaattcatctcaatcgtggacaactctgttacgagatgaacataagcgggcactcactcgagctggatagcacgaccattgttgatttcaacaaactccagtttcatccttatttgcgagccgagaaagagaaaggaaactggcatttcactgctgcggtcaacaaatcctggtttccggcagatgatctgttcagctctctccccaaaggattattcagcaatctggaaggcatcaagacaagtggcgagttgacctatcattttctattagatattgattttgcacaactagatagtctcaaactggaatccgaactgaaagagaaagacttccgcatcacaagctatggagccacttcactctccaaaatgtccggcgagttcatttatacagcttatgagaatggaataccggtgcggacttttcctattggtccctcgtgcaaacactttacaccattggatagcatttcacccatcctaagaatgtccgttatgcaaagtgaagacggagcattcttttaccatcgcggtttcctgcccgacgccctacgggaagcattgatttacgacctgcaagtgaaacgctttgcacgtggaggaagcacgatcaccatgcaactcgtaaagaatgtattcctgaaccgtaataagaactttgcacgtaaattggaagaggtattgattgtatggctaatagaaaatgaaagattaacttctaaagaacgcatgtacgaagtatatctgaacattgttgaatggggaccgctcgtttatggtattcaggaagcttctgcttattatttcaataaacgcccttcacaactgaacacggaagaaagtattttcctggcttccattatcccgaagcccaagcatttccgcagctcttttgctgaaggcggacagttaaaggagaatatggaaggctattataagttgatagccaagcggcttgcacagaaaggagtaataagtgaaatcgaggcggatagtatccgccccgatatccaagttacgggcgctgcccggaatagtctagccggtgaaaacccggagtctagttctccttccgctgaggagtaatgagattgatataaataataaaggaataggttatcttcttgaactgctgctgtttctttcagaggaacgggaagaactttgagtgctattgcttctcgtacttccggaagaagagcgtctttctgtttgtccactagaaacattgctccgggtagagctaccgccgcttcgagtagagctcgagctaccgctactccggttagaagtggtactgctgctacgactagtagtactaccgctactgcgactggagctactacgactggaactaccgcgactggaaccggaagagctattatttctctcggaactgttatttctattataggaaccactatcgtttcgtttacttgaactttctctcgaactgctacttgtttttccactttcacgattggaggaactggaaccagttgaacttccgcttgttggtctgcgattagagcttgaagaaccggaacctgtttccggacgacgaccagaattacgatcactttctactctattcgtattcccatttttatcaggagcaacattgttaccaggtctcccacttccggacggtgtagatggtctgacagaagtcgaaggccgatctcctccagattccggacggggacgtgttgacgtaccaggtcttgttgtcgttccgggacgagtagaagtatcaggacgagtagaggtacttgggcgagacgtaccaggacgcgttgtcgatgaacccggacgggaagaattacccggacgtgtcggtgcattatgcggacgagtggaagtattcggacggaaccggacagaaccgaaatccgaacgacgataagagtggaatactcgctgatctctcacccgatgcggtgcagaataatggttgaaattagtatatctgccccgataataactcacatggtgaaagtgtggacgataatgtgctccacaataagtacggtaatggtaaggcacaccaaaataaaacaaactgcgattcgggtaattaacataaaccctgaaactccatttccctccggttacatagattggccgatagaaatactcggcaccgaggaaccggcgatactgtgcatcactcaatatccagcgaagatcgtcattacggatatccaacgcttcataataatcatccaatgcccattcgtaaccacgtgctacgtaatccatgatattacggacagaataaataaagtcgtaattaatttcatacgcatcattatattgctgtgtactcaagctcaattcatatgccatcttatcggtaagaaaacgcgtctccttacgtaccttgctagtgctcattccagccattacggtcatattggcagtcagaccgacagcaaagagtaaaaacagtattcgtttcataattcaatctcctatcatttattattctgatgatattcctcaataaacttacgcatctcatctttatatgcattagaaaataaaatatcgatcaccttattaaaatttcttttatcccttacataaggatacagcttcttcatcatctccacctggtcaggagtatacgaaatctccttcactattttcacacattgatttgaagtgacatcatacgttctcaacatccgatcgacaagcttcttctggtcttcattcataaccgttattttaagcttattgataaattcatcaaactccggatcagtcatcaaacgagcttcttccacctgttcatgattaggaaagacttcaacggtagtgttcacagcaggcggtactacaacggaatgcattggtgcaggtctgccataacctttgaacgtatccatactaaccacctctctatttacaaactgaacgattatcgtcacaggttccgaagtaagtacaggcgtaccgttatcacgatggaattcccattcttccatatcaccgtcaaaacgccggaaatcaggttttcctaaaacggactctacctgagattgagtcattccctgatatatacccatcatctgtttggtagatacatagctggtaaaacagccactgaccaatattcccaacgccaaacacagcataatatgtatctttttcataaccgtatcgtttttagttaatagtatcaacgtttaccgtaccctatgataaaatccttcatcttttccttgctggagctaaatgtcagggtattaatcaccgtaaagaaagcttccttatctacaatccggggatacatgatcttcataatctccatccggtcatcatcgaatgtatatagtttggtcagttggagacattgggcagatgtgaaatcagaaccagccaatgcagcattgagcaacttcatacggtcatctttaaaaggctcattcttcatctctttataaaacgtttggaagagctgatcgttcatcaccctgttgtaaccatatcccggacgatgttctccctgttcgggacggccgggtctttccgggcgcatgttatcacgtccgtctacccatatttctgtcactcctctcccatcaaaataaacgagatctttatataatttttctcctttccatactcgctctcccgcacgggtaaagcgggtggcaaacacttcaacagtataatgtccgggatttaaattggctataaagcaggtagtagtaggtaaacatatctggttccctcccaggtaaacaagaatcggagtattcccgccatcgatacggattccgttaacagactgcgcttgtaaggagagggcagcgaacaggatacagaaacttattataatcttacgcatagcttatctagtttttaattatttatatctttaatctgatagcacaaaaatagggtgaggaaactccccaccccaatgattctctctattcgtatgtagggaaatccctattctgtttaggaatccgccaaagcaatgccatcctcatgcaaggtaatcagacgtttcttatacaagtcgcccactcctttcttaaaggttttcttgctaacaccaaacgtgtcataaatatcttccgcaggacttttatcattcaagttgatccgtcctccatgcgctttgatatagtcgagcagcgttttcgaaaaatcgtcaatcttttcaaaaccgggtttctgaagaatcaggtctaccttaccatcttcacgcacctgtttcacaaaagctttcatctccattcctgtttccaacggacagaatatttcattttcatacagcaaaccgctatacttattatctataatcgctttaaagcccaaatccgtcttctgccagataaggatattcacttctgcttccggagtatattccggcttttctttcgacagataacgttccacctttgctgaagccacaatacgataactctcttcatccaaatgcgcatggaccacatatttccgcccaacctgcattttcatcttctgctcactgaacggaacgaacaggtctttcatcaatccccagttcaggaaagctccgtattgattcacccaggagacttccagacaggcgaactgacctacctgcaccaacggagtcagcgtcgtagcaatcagtctttcatccatatccagataaagaaacacgttcaaaaaatctcctatcttacagtcttcgggcacatagcgggtaggcaacaaaatctcaccttcttccccaccatcgagatatacgccgaaatctacttctttcacgacttcaagctgattgaactttcctaattcgatgctcatattcttatctatttattgtaataagacacaaagataatctattttgaatagatctctcaaacagtcagccataacttttcgttatcgggcaaaactatttgcaatgaacaatctgctttctaatatgttaactttgtagcgacaaaaagaaaaagtaaattattcacctttaaacatataaacttatggaatttctaaccaacgagaaacttacgattgtaggagctgccggaatgatcggctccaatatggcacaaacagccatgatgatgagactcactccgaatatttgcctgtatgatccatttgccccggctctggaaggagtagctgaagaattgtatcactgcggttttgaaggtgtcaaccttacatttacttccgatatcaaagaagcgctgacaggagcttcttacattgtctcttccggtggagctgcccgtaaagcaggtatgacccgcgaagatttgctgaagggaaatgcagaaattgccgctcaattcggtaaagatgttcatcaatattgcccgaacgtaaaacatatcgttgtgatctttaatcctgcagacatcaccggattgattactttgttgtattcaggtttgaaaccctctcaagtttctacactggctgccttggacagcacccgtctgcaaaacgaactggtgaaattcttccatatcccggcttccgacattcagaattgccgtacgtatggtggtcatggcgaacaaatggctgtattcgcatctacaaccaaaataaaaggagagcctttgaccgatttcatcggcactacccgtcttccattggcagattgggaagcactgaaagtacgtgtcatccagggtggtaagcatattatcgacctgcgcggtcgttcttctttccaaagcccggcttatctttctatcgaaatgattgccgctgctatgggtggacaacctttccgctggcctgccggaacgtatgtttctaacagtaagttcgaccatatcatgatggcgatggaaacttcaataactaaagacggcgtcacttataaagaagtagccggaactcctgccgaacaggaagaattggaaaaaagctacgagcatttatgcaaacttcgtgatgaagtgattgaaatggggatcatcccagctattaaagactggcacgcattgaatcccaatattgactaatcaaacaatattagcaaaaagccgaaaaagagaaaatacatctctttttcggcttttattccaattacttacatatcacatataccccccacttagtctataaatctttcaagactccaattcaaatgactatgcaaagttggggataattcgtcaattaaaaaaatagacaaaatggggaaagtacctaaactgaagttacaggtactcaaagtgcgaaatatagtgattatcctatccaaattagtgaatggaataaaactgcgcatcgaagtttataaaatatctgtcatttttgagaagtacattcggaacaaactccttttagtacatagtttatactatgcaaagtaaatcctttaggcaaatcaatcaccgggatatgtgtaccttccaggcagaatgtacgatgacatttctcacaataaaaatgcgaatgtaaatcctgtaccacacaattgcaggagttgtcgcaaacggcatacttcaacgagccgctcccatcgtctatgctatgtatgaggtgatgagacaagaagagagcgatggtacgggatatagtcgatttatcgactgtatcgagcagtgtttccaaatcgagcaatgacaccgcacgctctgcctgcatcatcgcttttatcaccagaagccttatggcagttggcttgatacctcttctatccaacttatccaaataaatatcttcttccatctttctcctattttatcattttctgtattctgacagcattcataatggcaagtagcgcaacacccacatctgcaaagacagcttcccaaagagtagcaattccaccggctcccaaaatcaatacaagtaatttcactccaaatgccagtgatacattctgccaaataattcttcgtgtcagttttcctactttgatagcttcggctaccttcgacggctggtctgtctgtatcacgacatcggctgtttcaatagccgcatcactacccagtcctcccatagcaatgccaacatgacttagagcgagcaccggtgcatcgttcattccatcaccgacaaatgcgatccggtttgcctcatcctgccgcagctcttccagatgattcacttttccttccggcaacaggtcaccataagctttcgatataccgagcttttctgcaaagttagtaacaatactctgtttatcaccggatagtatctggatgttttcaatatttaaagcttttaaattgtcaatagctacctttgcgtcctctttcagggcatcagccagcagcagataacctgcataacggtttccaacagcacagaccacgatggtatccgttatttccagcagttcttttggataggatatatcaaacttagacagtaaccggcaattaccgaccagaaccatagccccgtctatcgttgcttccaaaccatagccggcaaattcttttgtaccggtaacagctacacattcaatgttttgttctttcgcataattcacaacagccttggcaatcggatgagtactatcactttctaccgaagcaaccagtttcactaattcttcttccgaaacctcgcctgcacttttacaggcctgtacttcaaaggttccttttgtcagggttccagttttatcgaataccactgtattgatcttagtgatagcatccagataattaccacccttgaataaaattcccaaccgggatgccgctccaattcccccaaagtagcccaacggaatactaaccaccaacgcacagggacacgaaatcaccagaaagaccaaagctctgtatagccaatcattaaatgcaaatacaaatggaggattaataagtgaataaacaaatggacacaaaacaattaacactgcaagcgctataacaataggtgtataaatgcgcgcaaacttacgaataaacaattcagccggagccttacgttcggaagcattctgaacaagttccaatattcgggcaagtgcactcttatcaaaaggtctcgttacctcgagccggataaccttatcggttacaatcattccggcaagtacttcttcacctttccgaatattacgaggaacgctttcacctgttaatgcggctgtattgaaggcagccacttcattctgcatagttccatccaatggcacccgttcgcctgcctttatttctatgatttcaccgacttttatctttttagggctttcaataacaagattgccttcccggagcactaatgctttctcgggtcttacatccaataaggctccaatattacgtttggctttatctaccgctttatcctgaaacagttctcctactgtatagaataacatcacggctactccttccggatattcaccaatatagaaagctcccaaagtagctataatcattagagtgaactcactgaaatagtctttttccctgatactttcccaggcttctttcatcactggaattcctaccggaagataggccacgatataccatatcaaggcaacagatccttcacggaagaatgctaaatcgagagcattcataattattccacttgtcagaagcaggagagagaatatcactttcccatattcatggaataccgaaacctttgcatcaacctttttttctgctgcgcatgaatgagcgccacaactacaatgtcccataacattcatcatttagttgatgcaaaggtagcaaatgattcatgcaacaaagttgcaaaatcggtttcagaacatatatcccaacgagatcatcaggtttctgttcttcattccgagatcttttgccacttcaacgagtccaaaatcataactaatggccacctgatatttcttgctgaactcaacgcctgctttcaacccaagaccaaagtcgaaccgtttcagaccatcatctccaaatatatcttcggaggctgaattaccgtccaagcccgctatatccgcaatatcaccatccaccttcgctttcatctttccaaacaaaccaacagcaacataaggtcctacacttccaaatagcgcaaagtcatcattgactgcatatttatacccaacacgcaccggtacttccaaataatacggattgaatgtcagactcgccactgatcctccgtcaatcttagcgcctttcaatgtcagcaatgcagcgaaatccatatatgcgccactgccattcgcatcctgcgacaatccgacctctgctttaactcctgcgtgaaaacctatcctgctgtcaaaccctgtaatggtgtatttgctaacattcatacctgccatcacaccccatttcaggttgtcttgagcattgatactcactacgcttatcgctactaaagcgaacaataacaagacctttttcatacgaataaataatttaattattgtttagaaattatgtgaggcaaaaataacaataattcgcataactccgagagatttagtaaaaatataaaaaataaacgatatgaatcttatgaggtatagtcatagcaagagaaccggactatttcaaacgattttacgagatatagaacaaaaacactctgtacagagaaaaaacaaagaatgaaagactgtataacttaattaattgttatctttgcacaatcagtcgtagcgcgactgtattgtttgttttaagaaaaaaagcgtttagctgatttctgtgccagagaaaagtcgaaaattccaaacacacagagaagcagatagatgctccttgcaatatgcggggagtgtttcctgtttgtgtgtttagggcttcgactccctctctggcggataggcaaatgctctccgctttttttgtgcctataaatttgcaatagatacaaacgacaaattagtaataatcacaaaggcaagtcaattcgggtggagcggcacccgaacgactacagagtcgaaaacgtaacatttagatgttactacttgcctttgaaaatataagagacagaggctagctacacctgcaaggggaacaaatggattcatccaggagttcccctctatttttgtgaagatgtgtactattggaaagacagatattaggtctacatataaatttgatgattcttattgtcaaccaaagcttttcccaaataatataatgattatcatcggtttacatgctgacaataagccatggcaatagcctgacaataaaaaaattagaacttttattgtcagcctgttctttgatccctttggggcaaggttatgggattcattccaatatgtcgatatactctaacttaattcccagcttgatccatgttataaactactgaagactatcattgtctacagtaacaataccatcgacataaaaaacacatacgctttataaaatgagtatgcccctgttaaatgaatgctacataaccggtatctttcacttaccaagcaggtattgttccactaaagcactggtatctttagtggaacaatactgataccctagaggaactatactggcgtgttaacggaactatataggtatattaatgaaaagatatcactttggaaagctgttataaaaatgcggcattacttcgaaacatgttcataaagctattgtttatcaggttattaaaaggatcataagagataaaaataaggctgacagtaaaagtagatatattttattatcagcctattatcagcatctattgtcaggtgatatagcattgatattcatatacttaaatactattctgacagtttgacaataaaacaggtacaaatcaatagaaacgatcataaagtttttaattgggaaaagcaaagaatttataaaaagaaagaaaaagtttgctgttcccttcagaataaacatctttgtaaccgtggttacagtaacctcagttactaatataattcactgactatgaggttttataatagagaggaagaactgaaaaaactgaaagagctaaaatgaaaaaagaccttctccttacagttttattcctctcactaatatatttacccagcgatctaaagctctttccatcaaatttaacgaagaaccgaataacacaaaagcatcctatagcttacaacatacatatattcatctaacattcaaatatttatattaatagagtatattccacccaagacaatatatcaaaataatctttcatatacaatataaatctgcaacgtataaaagtaatttaatgacaggataaaaaagaaaagattaagttttatcatttttcacagaacaaacatgaccgtaacaaagaaaacatactgcaataaaagccttttacaattcttttactatcatagagttaggttacgggaaaatctccggataaaccttgtttcgagaagtttttttgttacttttgccgcaaactaatatatttcagtgcaacgggaatcttattataatatgaaagacatcaccttatggaacatcatgttgaaaggtgacacaaagccattagaggtattgtataagagacattacgagcttctattgaattttggactcaaatatgtttcagatgaagaatttgttaaagattgcattcaggatcttttcgtgaaactttgcagcagcacccgtttgtctcccaccgattatgtgcgttcctatctgctgacttctttgaaaaaccttatattcgataaactttcatctttaaaatccaccgaagatatcaatgcgcttcccttcgacttaacgatagaagacacctcactggaagtcttatttaaggataatgatgaggatatacaaatgattaaaaatctgcaagaggcttataaacaactgtccgagaatcaacggatggcgatttatcttcgttacattaaaggcttatcctatagagaagttgcagctgtcctggagattaatcctcaatctgccatgaatttagtatcccgcacactgacgagccttcgctctaaaatgaccttgaaagaatatctctttttccttcctttttttctttcttaaatgctactatttcctttgtccggttcacccaatttgctgaagaaatctttttctgcaaaataatgaaagaaaagtgagtagactttttcttttctcccgttttaaatataaaagcaaaaaatggaaggcaagaaagcaaatatacatcaggtgatacgcaaagtaattctacatgttcggaaacaggagagaaatgtctcaacgaccgaactggatgaatcatggagacttatcgaaaaacaaatccatgcaaccaaaaagaaaaagttgcatcaacgattactttatgcggcaacttattcatcagttgccgcaatcctgctatgtatgttttggctgggtaaacagttcatctcttattaccatgcagatgacagcgcattagtcgatttcgcattgaaaatgcaggcagccccattacaagaagatattctattgttgataccgggagaaaagaatatagaagtgagtgataccgatgcaaatatcatttattcgcagaatggtttagtggtggtcaactctgatacagtcaatcagattcagccacaaaagaagaagcccgaattcaaccagctgataacccctaaagggaaaagaactcaattgactttaccagacggaactcatctatgggtgaattcaggaacacgggtgatttatccaactcattttgaaagagaccagcgtgaaatttatgttgaaggagaagtgttcctcgatgtacgccgcaatgaaaaagcccccttcatagtaagaactaaagattttcaagtacaggtattaggtacttcattcaatatatcggcatattcatcggagaaaacgtcttccgtggtgttggtggaaggaagtgtgaatataaaaagccacaatcagcaacaggtcaaactcgctccgggacagctggttaacattcatagcgaccaactggacactcctcaaaatgtagatgttgagccttatatctgttggataaagaatatcctaatgtacacagacgattctttggataaggtctttagaaaattaaatctatactatggcaaagaattcgtattggatacggaggtggagagaatgcaggtttccggaaagctggatttaaaagataaacttgaagacgtcttacatactatatcttattctgcacccatagaatataaagaagtgggtgataaaatatatgtgaggaagaaataagtatagatcatttattgttaaacctttatacgtaatattatgagaaacaaaagtccttaaaaagaaggctgaatgataattgcagtatcatccagccgaaaaatcaaacaacatttaattgtttaatttcttaaaaacgttgtaaatatatgaaaaataccagtagcacatttcttacaagggtgagaatggctcgcatattatttctttttagtgtttgttttctttctttacactcttatgcggcgaacataggagcgtatgctcaacagaaaaacttaacaattgaaatgcggaacaaaacagttaaggaagtacttgattatatagaaaaaaacagtgaatttatctttttctattatagcaaagcgattgatacgaaacgtatagtcagtttgtctgtaaaggaccaaccgataaccgttattctcgatcagttatttaagaatacagatgtcctgtatgaaattaaagaccggcagatttctctgaaaagagaagagttgcctacagagcaacgtccgcaggattcgaaacaacaaaagcgcaaattggtaggaaccgttacggatgcttcttccagcgatcctttggtgggggtcagtatttctgtaaaaaactccccgggaacaggaacaattacagatttagatggtaagttttcaatagaggtttcaaataatacagagttaacattttcttatatcggatacaaacagcaggtattgagtgtaggcgatttgggagttttgaaagtgaaaatgcaatcggacaacgaggtgctggatgaagtggtggtggtaggagccggcacacagaaaaaagtatccgtaaccggtgctatttccactgtaaaaggtgtagaattgcgtgcaccgagttcttcactgaccaataatcttacaggaaagctggcaggtgtggtatcgatgacaaccagtggagaaccgggttccgtatccgatttctatatcaggggaatcggaacattcgggggacgtgcaacacctttaattctgatggacgatatcgaaatttcgagtggcgaccttaataatatccctaccgaatcgatcgccagcttttcaatcttgaaggatgcatcggcaactgctatttatggcgctcgcggtgctaatggagtgctgcttatcaaaacgaaagacggtatggaaaacacgcgggcacagataaatatcacgttcgaaaattcatttctaagaccggcaaacacgctgaagttcgtcgatggccctacgtttatgaatatgtacaatgaagccttggtgactcgtactccaagcgcaacacccaaatattcggatgacgtcatagaatatacaaggagcggaatcaatccgtatgtttatccgaacgtggattggtatgacctgcttttcaaaaattctaccatgaaccaacgggcaaacattaatgtacagggaggtagttcgaaggttacctattacatgagtttgcaagcaaatcatgatagcggtatgctcaactcccccaagcgttactcttttgacacgaacatcaacagatgggagtacattttccaaagtaacatatcctataagatgactccgacaaccactgtcgagctacgcatgaacgaccagataggatatgccaaaggaccgtctttttcaacttccgacctgttctatcttacctacaataccaatccggtggcatttccggcatcttttccggcagaagaaggtgacaagcatatacgtttcggaggggcaatgcttagtggaaattcgatgtataacaacccttatgcatatatgataaataatttcagaggatccaatcataataccatcaacacctctgttcgtattaatcagaactttgattttgtgacaaagggactttccgcctctattctggttaactggaaaaactattcaaactcatcttataccaaatcacttgccccctattactatcgcgtacaggatggcagttggaatgtcgattcgcccgacctttatgcattggagcaactgacttcgggatctgaatatatatcccagtcggatatagagcgctaccaggacaataccttttatatggacggacgcatcaattacagcaggcagttcggccgacatgccgtatcgggaatgttgatgtatatgatgcgtgaatacagatccagcgtattacccaaccgcaaccaaggattatctgcccgtatcacctacgattacaaccagaaatatctggccgaaataaattgcggttataacggaacggaacgtctggtagaaggagaacggttcgagttatttcccgccatatctttaggctgggttatcagtaacgaggatttctggactccactgcgttcaattgtatctttcctcaagctccggggatcttatggactggtaggcagcgatgatacgggaaaaagtgcgggagctgcccactttctctatataaatgatataaagctcgacgatttgggttatggaaccggacctgatggaagtgttgtcgccaaaggacccagcgtttcatattatgctgtcagaaatgcacattgggaaagagtgaaaaagttcgatatcggtatagacatgaatctattcaaccagctcaatattgttttcgactattttcatgacaaacgagatcgcatccttctcaaacgaggttcttttcctagactattaggatacgctaatgctgtgccatggagtaacattggtaaagtagacaatcgaggtatcgagctggctgtcaattggcgaaagaaaatcaccaatgatttaaatatggacctgcgtttcaatttgacatataataagaataaatacatctacaaagatgaaccggattacccttacgtgtggcagtcggaaactggtaaacccttgagtaacacgataggatacattgccgaagggttattcaaagaccaggcggatatagaaatgagcccttcgcaggatgaattgggaagtacggtaatgccaggtgatatcaaatatcgcgatgtaaacggtgatggcaaaataaattcaaaagatcaggttatgatttcgcaatatggcaatgtgccgcgcattcagtatggaattgggctagacatgacatataaatctttcgatttcggaatgtttttcaatggttctgcccaacggacaatcatggtatcaggcattatgccatttcgcggtgatgcttcaaccggtgatcgaaacgtgatgcagtttatcgccaacgactactggagcgaagctaatccgaatccggatgcgaaatttccacgattaggtattactgacagtcaagtggcaaacaactctgtcaacagcacctactggatgcacaacggacgttttatccgctttaaaacccttgaactcggatatagttttccgtactgccgtgtttatatcaatggggataatctggctgtgtggagtccttttaaagagtgggatccggaattgtcatggaatgcgtatcctcttcaacggactatcaatattggagtgcagctaaaattctaagttctatataaccaaaatataaaatatgaaaaccattaagatcatatcacgattcatactaagtgtgactgccgcatgttgcatggcttcttgcaactatctggacgttgtcccggatgaaacagccgacttgcccgacgcaatgaaagacagagcttccacattgggtttccttcattcatgttatacttatttcgagtggttttacacagttgaaaactcattcatcaactcgaccgatgaatatgcccgccccttactatgggctgacgacggacagaaagcggcatggaaccagctttctccttccagtcaaaccgccccgtggaatagttgttacgatggaataggacgatgccatctattcatggatcagcttgacaagagcaatccgacgggagtaaccgagagcgataaaagacgctggaaagccgaagctttgttctgtcgggcactctatcattttatgttactagagtcatacggacctataccattagtgactgaacattacaatcaaaaccttgacaaaaaggattttccgggcagatcgcatttcgatgtatgtgtagactccatagctgaatggtttgaccgggctgccttcgaattgccgccaacagtacagaacagcgaactgggacgtgctacttcaacagcttgcaaagccttaaaagcgcgattgttggtttatgccgcctcccccctgtggaatggctcattcccttattcaaactggaagaacactaactttgaaactccgggatatggaaaggagttagtcagcagaacatacgatgaaaacaaatgggaacgcgccctgacagcttgcaacgaggctcttgattgggcactgactcaaggtaaccgcaaactgttcgaccttgccacttccaccagtatcagaataaaccaaggagttccattgcctaatatagagggggttgatgaccagtttaaagagtcggtaatgctcatgcgttacctcaatacgacacgtgagactgatggcaataaagaagtaatctttgccatcggaagcggtgacaactatggcatctattcacaaatacctcatggcgtcaccacttacaacggctctcctgtaggaggatggggaggtattgctgttttcttgaactctgttgaaagattttatacaaagaatggaaaattgccccaatacgatcatacttttcccgataaatcggactggtttgaatcggcaggtctgtctaatccggatatcataaaactgaatgtcaatcgtgaaccgcgtttctatgcatgggtttgttacgatggaggtgaatatagttcgttcatagccgatggctcaccactgatacttgaagcgcgtaactcgcaaaaacatgggtacaaccctgacagatataatagagataataatgcaaccggatatttctccaaaaagagaatacaaccaaacttccaatggcgctctcaagataatggcaataattatgctcatactccactggcagtcatacgtttggcggaattatacctcaatctggcggaatgtcatgctgcattgaacagcaaacaagatgtcttggacaacctgaacattgttcgtaatcgtgcaggtattcccgatttagaattatctgacataaactctgatatgagtttaatggattgggtgcgcagtgaacgttatgctgaattatggtttgaaggacaccgctattttgatgcccggcgttggacaattgctccggaggtattcaaagccggtgtccgtgaaggtcttaatgccatcgcaaaaaaagatccatcgttccgtgagtttaaccaaagagtaaaggtggaccaaccttttatgtggaacaacaaaatgtatcttcttccgatcaatgactcggagatatacagcaatccccaactagtacaatcgcccgaatattaatttagaattaccagaattatgaaaacgatattattgaaattaattttaatacttggtgtatgtcagattgtatattcatgtagcaacgaatattcgaatgataagttattccctgaagaatatcacaaaatattgtatttcaagaacgagggcaagcatatatttagttggcaggcttctgaaaatacggtcgaagagcctcttctggttattaaggcaggaagtgacccgtctttgactgcaacggttaacgtgcgtgcattgacacaacaggaaatcgatgaaaattatagccagcccgaaaatcaaagttacaagacaataacgcctgatgcatattcatttaaagacggagttcacgaactaacgtttgcaactaacgagacgtcgaaatatctttatctgaattttgatgtagctaaaatatatcagttaatcaaatcggcacctggatctaaacttgttttggcactccagttggaaagtacagaagagggtattgtgaatgttgaaatgaaccgggtcttatatgtttttgatataaacgggcagcaagtggaatggggaaaaaaggatatacagattgaaagtgcgacatatagttcaatgagtgtaaaactcaaagccgaaattgcagataatatatccaatttctcttgcggactcgatttctcacaaaacgcgcaactggtgtctgcatataatgattttcattcaaccaattatgaagcgcttcccgcaggagcctaccatgtgaatgatttttcttttgcaaatggcaatgatgatgctacaacgacattgacagtagcaagttcaacattgcaaaaagataagcactatcttcttccgttgaagtttgcagccccctcgtccccacaaatagaggtatcggacgagatttattacctgactgttgtggtacctgctgatccacaagtcattcccgacaacagagaatggaaaatattgctatgcaacagcgaccagaagatggagaatccctcatcaacggatggggataatatcggagccggagccatcatagatggaattttcgacaatcactggcattcgagttattggggaaaagatgtcaatggattcaataataaagatgactaccactatggcttcacagattatcattgttttgatggaatgagaacacctatcacaattgtcatagatatgaagaattcaatagaagtaagcgatatcggactgactcaacgaagagataacgcgaacattaagaagatagatttctatgtttcggacgatcctctatttttattcaaaacgattgccgatggaggaacatctgctgattactcggctgtggcactaaataactggacgcttctcttttctaaagagaacgctccacgacagaatgaaaccatctggttcggtgacagtgagacgataacgccacaaaagggacgattcctgaaaattgtaatttccagtgcatacaacgatccctatgggctcaatggtgtggattacatcgttgtcggtatggccgaattgcaagtaaaacaactttctacaatgattggaaaaataattcaataagatgaaacacagatttaattttttaacacttttgctggtattgtttacaataccagcaggtatctttgccagagaaagcaaattcacaaagcgaggcagcggaccattgttttggaatatgtaccaatacaatttccggtatggaacatcaatgcctgaagatgtttggaaaaagaatatcgactggcttgccgaggagtttttaccttatggatatgatatggcagctactgacggttggttatttaacctcaattctatagatcaatatggttatctgaccaaatatgacagttcgtggacatacggactgaagtattggggcgattatctcaaaagtaaaggcatgagattcggattctatttcaacccattatgggtacctaaagctgcctatgtgcagaataataatatcaaaggaacttccattccgataactgacgtggtaggcactacaaagtttgaagatcacctgtactggatagatactgacaaaccaggagcggaacagtgggtgaaaggctgtatcagaacaatgatagatcagggaatagagttgctgaagatagactttcttggttactatgaacgggattacggaaccaatagatacatcaaggcattgaaatggatggctgaagaagccggagatgaaatgttgcttagttactctgttcctaattgtcgcaacgatgcccgcaacgagattatttatgcggatatgattcgcataagtactgactgtgacggtggcggatggtggtttatcagcgacaaagagcgcggacaggttaacgaaagcggacaaggtgataaataccgaagtgcttttgatggattaatcggatgggctgatattatcggggtgaaaggacaaactataatggatcccgattttgttcaactcaacacattggcaagcgatgccgaaagagagtttcatatctcaatgttgctggttagcggttctccaattggtatcaccgatcaatataatacgattggtgattgcgccaaattctacaaaaacacagagatgctggaattgaataaactcggttttgtaggtaagccacttagtaccagtatatgggataaacaaaacagttcgagatggataggacaacttcctgatggagattggattgtcgggctgttcaatagagaatcgacagtgcttgaatatggtattgattttgaaaaggaactgggaattaaaggtggaaaggtgaagaatgtacgtgatttgtggctgcatcaggatttaggcgcaatgtcgggccgatactcggtgcgacttgaaccacattcatgtaaggttttacgtatcaaacccaattcaaagagatacaaagcggctgttgcctcactcagaaatggtgcagttataaatagataatgattatgaaaggataccctcaatatttatggtttgtagttctcgccctattactggtttgcacaggttgtagcaatgagggtgagacagaagacgataacaaccagcatgttaaagtcgaaggcttttatgtcaaagggcttgaaaacgtaaatgcatgtgttgagtttgatgtagaggttgatgccgccggtacatatacattgcatgtcatgggctacaactattccaaagggacagctacgtgtagcttatatgtcaacggtcaaaaacaatcgcaacttggatttcaggaacaatccaactggagcgaaaaagtagttcaggtatcgttggcagccggcataaatcaaatagcctttcaacgggacgctggtgataacggacagttttatctcgattacatagaaatagactaatagtatgtttaccagaaagatgaaaatcgttttattgctttttgtattgttctgccttgcagataatgctaatgctacacctcgctggcgtatcctggatagtggagcgatagaatggcagatagacggtcggctcccccattatgaccatattgaaatgagcggtttaaaggtttcagcggtattacgttatggcgtaaacggcgatgggcaatttgtgatggaacgttcaatgatatggcctatgttgcggacgatacccaacaatacacatgcaagcctgatgcaacgatttgcaattgattacgcttctttgttgttagttaatggtatggctctcaacaatgaaaaagtgaaatcgatatgtatcgacggacgactcacggtagtaagcctttttgctattggataccagaatacaggtacggcacgcaatagagagccagtacctgtagtcgaacttacgagatcattctttccttcaacagacaaaccgatgctttgtgaacgttatacggtcaagaatatctcatcaaaacctatttctgttattgtaccttttcaaaaagccgtttacaaaaccgatcctgtaaaaggagtggatggatcatacactatagttacctctatacaaaataaggaagactgtttatacactattgctcctaaagaatcattgactttcgacgcttctgttcaggcttataaaaaaggagagaaagaattgatagtcgatatagcagacgaggaacataaacgaatggcctttgtcgacaagatatggaacaatcttagctttgtctcccctgatccggtagtaaatacagcatttgcttttgctaaagtaagagcagcagagagtatctttgctaccggaggaggattcatgcacagtcctggaggagaatcatattatgcagctgtttgggcgaatgaccaagcggagtatgccaatcctttctttccctttttgggttatgatatcggaaacgcgtccgcattaaactcattcaggctttttgcccgcttcatgaattctgattacaaacccatacccagctctatcattgccgaggggaaggatacctggaacggggctggcgatcgtggcgatgcagcgatgatagcttatggggccgcccgttatgcactagccaaagcagataaaaaggaagcacaagagttatggcccttgattgagtggtgtctggaatactgcaaaagaaaaataaatgcttccggaattgtgacttcagatgctgatgagcttgaaggacgctttccagcaggtaacgcaaacctttgtacatcaagtttgtattatgacgctctggtatcggcaagctatcttgccaaagaacttggcaagcagtcttctgtttcaaaagaatatgcccggcaggcgaaagtattaaaaaataatataaacaattattttggtagccgtatagaagggttcgacagttaccgctattatgaaggcaatgatattttacgttcatggatagctatccctctgacagtcgggatctttgaaaagaagacaggaaccgtcgaagcattattctctccccgtttgtggagcaaagacggcttattgacacaagccggaacagatactttctgggacagatctactctttacgctctacgaggagtgtatagcgcaggagcaagggagagggcaatggaacacatggcatattactcacagcaacgcctgcttggggaacatgttccatatcctatcgaggcctggcccgaaggaaaccaacggcatttgtcagccgaaagtgctttgtattgccgtatagtaaccgaaggtatttttggtattcgtccgacaggatttaattcattctcactctgtccacaactacctgataaatggaattcgatgagattgaataatgtttcggcatttgcattttcgccgtttgatataatcgttgaacgacaaggaaataaaataaagacctatgtgctacgtaatggaaagcccgtgaaaacatatcacacagagaatgggaaagatataaatattaccttctaaaatggcttttatttagatatggactatgcggattcctactcctgattttaactaaatccgtattcatccgtgtaatccatatctaatcaatatcattgttggttttcttctcggtctatccgaataaacttcagaagtcgttctaccgcttcttcttcaggaatatttttctccacacacaccttgcctttatagagactgattttcccccgtcctgctcctacatagccgtagtctgcatctgccatctcaccgggaccattcacgatacaccccatgatgccgatcttcagccctttcaaatgtgaagtggctaccttaatacgggcaatagtcttttccaagtcgtaaagtgtacggccgcaaccgggacaagatatatattctgttttggaggtacgggtacgtccggcctgcaagattccgaaagcagtagcatcaacgacggcatggctcaagttaccctgattgaacaggaagatgccatcacaaagaccgtcaaaaatcaaggctcccatatcgactgcggactttatctgcaaattctccgcatcatcttccgaataatgctggaagaagacaaccggattttgcaaaccttccgtcattagttgatgtaccagtgcacggtgctcacccaaacggttcggatgattgctttgggaaacaatcactacttccggatgatgtttcaggcaggctatcacttcgtccgtttgtgccatgtagggcataaacaggaatttaacctctgcattgcattctcccattaacggcagctgtgcatgattgaatgcaggccaggttccgtcttctccctgccatacatccgcatcaagaatatattctactccgtcttcccgttgatcgggcaaggttcttccggcataaatatagtccggtgtgaattgcaggtttacctctgtcttcccatccatacggtcggcaataaccacaggtacatgttcacctccgatattacggacggcttttgtcttgcgacgttcgggagacagataattgaattccggtgcctccaatcccgggatataaggatgatcctgcctcaacagaacataatccaccagtttacgggccaccgggatttcagcttcaggagcttcgctcaaagagacccgaatggtatctcccaatccgtcactcaacagcgcaccgatgccaagggcggacttgatacgtccgtcttctccatctccggcttctgtcaccccaaggtggagcgggaaagtcatcccctctttttccatgacgtccaccaacagacgaacagtcttcaccattaccactgtattggaggctttgatggaaatcactacatctgtgaagtcctccgctacacagatacgaaggaattccatacaggattccaccattccttcgggagtatcgccataacgggacatgatacgatcggacagagagccatgatttactccgatccggatagccgtgtgattctctttacagatattcaggaacgggacaaaccggtcatggattttctgtatttcctgcgcatactcctcgtctgtatattccagtttcttaaaagtacgagcagcatctacataatttcccggattgattcgcaccttttccgcatattgagcagccacgtctgccactttcggattgaaatgcacatcagcaaccaacggaaccatatatccctggctacgcagtccgatattaatgttcatcagattttcggcttctttgatgccctgggttgtgaggcgtacatactctccacctgcatcaacaatacgtttcgcctgttccacacaagcctgtgtatcctgcgtagacgtgtttgtcatcgactggacacgaatagaattggggccgcccaacggcacagccccaatatttacttctgtggtttctcttcgaaaataattgaatagatccattagttcgttttatattcaaacttcacttctttcagttcttcgtttgcttttacgattttctttttcagtccttccttgtaagcagcaaaagcttctgccagtttctcatcgctcaatgccagcatctggatggcaaggatagcggcattcatcgctccgttgatggcaaccgttgctacaggaatgcccggaggcatctgaatgatagaataaagtgcgtccacaccatcgagcacggaaccttttacaggtactccgatcaccggcaatgtagtgttagccgcaattacaccgggaagggcggcagccattccggcagcagcgataattactttaatgccacggttgcgggcattcttcgcaaactcttccacagcttcgggcgtgcggtgagcagaaagagcgttcatttcgaacggtacatgcatatcattcagtagctgtgcagccttctccataacaggaaggtcggacgtgctgcccatgataatacttacaattggagtcatagaataaaaattaaaagcctcttcacagccctttcacgaagagagggggttcagctacattcaacttatattagttatatttctgtttgcactatccgtttaccacggctttatacgcttcggcatccagtagatcttccaccgcttttacatccgccggcttcactttaatcaaccaaccttcgccatagggatctttattaaccagttccgggttttcttccaatgcttcattttgttcgagcacctcacctgctatcggcaggaaaagatcggaaatagttttcactacttcaatcgttccgaaagtttcaccggcttccaacgtttcaccaacagtcgggatatctacgaacacaatatcgcccaattgttcctgtgcataatcggtgataccaacgtatgcaatgtctccgtcaacgcgaatccattcgtgttcgttcgtgtacttcaaattctgtggaaagttcataatgattagtttttaggatttatactgttttaaaataaaaatactcgaaataagatgttactcaccggatgaagtaccaaaagggcacatatcagaccgacagcaaaaccggaaagcacctcacccagtgtgtgatgtcccagaacaatgcgtgcagaacccaatataccggcaatcaaaataaacaggcatagccatccgaccggattgtaaccgaacaaggcactgaaagaaatcaagcctccgatcaccccgcccattcctgccatgtgttcgctcaacttccatttcaggtttactgcaatgcaaatgatagacactaccagggaagcaagaatgataccagtcatataccacgggatattcagcctacgcatcatcagcaggcagaacacatacgagataatggtcagtagaataggtacataacgcttcttacgttcactcaactcctgacgggcaaacccattgattttacgaaacaagaaaattgtaatagtaggtgtcagtatggtgaagcagtaaacgattcccaacactatcaacttatattgtatcggcatgatacgaagataagaaaacaggaataacaccagaaacgataaaaacggaatagaaaatggagtaaagaccatcgaagtgactctcgccacctgcaacatcgtcttatccgctatgatatgttctctctctctgtccactcttctttgattactagttactaattataaattacaattctcattcttcattgtcaattatccattatttccgcagtctcgccacgggaatattcagttgttgacggtatttggctactgtcctgcgggcaatgggataacctttctcctttaatatatccgccaattcatcatcggtcaggggtttcttcttgtcctcgccttcaatacactctttcaggatcttacgaatctcacggacagacatctcttcgccatcttctgtggtatatccgtcactgaaaaagtatttgagcggatagataccgtaattcgtctgtacatatttactgttactcacacgggagattgtcgaaatatccaatcccgtacgttccgccacgtctttcagaatcatcggtttcaatagcgattcatctccttccaagaagaaaggacgttgcaggtcgataatcgcctgcatggtaaccatcaaggtattctgacgctgacggacagcatcgataaatccttgtgccgcatccattttctgtttcagaaacatcatcgcttctttagattccttagactggttagccctgttttttgtatgctcctccaccatttccgtgaagtcacgactcatacggagttcgggaacattgcggttattgagacttacattgatggttccgtcatcatacgtttccacaataaagtcaggaactatttgttggagatttctgccaattgcttctcctaaagaagcacccggacgtggattcagtttggttatttcagtaatggtttcctggaaagtctcttcatcaatatccagtttctttataatcttctcccaatgtttacgggtgaattcttcgtaacattctctgataatcctttcttccagattcaagataggactgggagttttctcttcttcttttttccggcgaatctgtatcaacagacattcctgaagactacgcgcaccgatacctgccggatcgaagtcctgtaagatgttcaatgcttcttccagttcttcttcggtcgattcgataccggcataaatcgccagttcgtcgcagatactttccaaagatttgcgaagcaatccgtcatcatccaatgaaccgatcaggtattccaccaagtcacactggtgctctgtcaggttgcgttcacgcaactgttctttcaggatttcataaaaagaggtggagtcggaaaatggaatatcctccgcttgttcatctttcgaacggttgttctcttgcaatttataatcgggaatatcgtcttctgtcagatagtcactcaaagaatcatagtcattggcatcgctatccatgccatcctctgcattctcggtatcggaatattcattatccgtagcattctcttctttaccttcttcaagtgccggattttcaagcagttcagcatggatacggtcttccaactctactgcgggaagctccaacagtttcacgaccagaatctgctggggcgagagcgtctgtacctgctgttgcgcctgagattgtatttgacgggaaccttgtgccatattcgtttttgctttctactgtttctcgctacaaaagtaactttttaacgagagattacacagattagggagataatttttaatcctataacacaaaattcgttatctttgttgcacgaacttaaaaactaggacaatatgtttgccaaagaaacgtatatgcagcggagagccctgctaaaaaagaacttaggctccggagtgttgttatttctcggaaatgacgagtgcggactgaattacgaagataacacattccgttatcgtcaggattccactttcctttattatttcggactttcatgtgccggactttcggctattatcgatatagatgaagacaaagaaattatctttggtgatgagttgtctatcgacgcaatcgtatggatgggatcacagccgacgttgcacgaaaaatgcgaacgtgtaggcgtaaaaaatctgatgccgtctgctgacattgtaagctacctccatcagtgtgtacagaaagggaaagcaattcactatctgcctccttaccgccctgaacataaactgaaactgatggactggctgggtattcctcccgcacatcaggaaggttctgttccattcatccgtgccgtgatcgctcaacgcaactataaatctgcagaagaaatcgtagaaatagaaaaggcttgcgatgtaactgccgatatgcatattacagctatgaaagtacttcgtccgggtatgtacgaatatgaagtggtagctgaaatgaaccgggtggccgaatctaataactgccagctatcattcgctacaattgccactatcaacgggcagactctgcacaatcattatcacggaaataaagtgaagccgggtgatttgttcttaatcgatgccggtgcagaagtagagtcaggttatgcgggtgatatgtcgtctaccattcctgccgataagaagttcaccacccgtcagcgtgaagtatacgagattcagaacgccatgcatctggaatccgtaaaggctctccgtccgggtattccttatatggacgtatacgaactgtcagcccgcgtcatggtggacggtatgaagacgctcggattgatgaaaggaaataccgaggatgctgtacgcgaaggtgcccatgcgttgttctatccgcacggactaggtcacatgatgggattggatgtacatgatatggagaatctgggagagatatgggtaggttacaacggtcaaccgaagagcacacagttcggtcgcaaatcgcaacgccttgctattccattggaaccgggttttgtacacacggtagaaccgggtatttattttattccggaactgatcgacatgtggaaagcagaaaagaaatttaccgattttatcaactacgagatagtggagacttataaggacttcggtggtatccgcaatgaggaagattatctgattacagaaaccggtgcccgccgattaggcaagaagattcctttgacaccggaagaggtggaagctttaagataaaaagcctcatcaaaataaaagaagaacctttcttctattcaaaatcaatagcggaagcttttcatccggatgaaaaacttccgctatttttgtcaaagtaccaaatagtccatctaaaatcacattttttctacccttcttttcccgaatcttgcgtaatattgcaacagaattaaaataattcactttttaatgatataaaaacaatgaataacaccatgaagagactacttttatctgtatggctattgtcactttccttactgtccgccgtagctgaaaactatccttataaaagcgatgtgctttgggtcaccgtacccaatcatgccgactggctttataaaaccggagaaaaagtaactgtagaagtacaattctataaatacggcatccccagggataatgtaaccgtcacttatgaaattggcggtgatatgatgcctgttgccgatacaaaaggaagtataactttaaagaatggcaggggggtgattcctgtgggcacaatgaaagagccgggattccgcgactgccgcctgaaagcaaccgtagatggaaagacctattcacatcatatcaaagtaggattttcaccggagaaacttcgcccatatacaaccatgccttccgatttcaaggaattttgggaaaaggctaaagcggaacaaaaggagtttcccctaacgtataccaaagaacatgtcgaaaaatattccactgataaaatagactgttatctcgtaaaattgcaactgaacaaacgtagacaatgcgtctacggatatttattctatccgaaaaaagaaggaaagttcccggttgtcttatgccctccgggagcaggaatcaaaaccatcaaagaacctctacgccataaatattatgcggaacaaggatgcatccgttttgaattcgagatacacggcctgaatccggaaatgactgatgaagaatttaaagaaatcagcaacgctttcaatggcagagaaaacggctatctgaccaacgggctcgacagtcgtgataattattatatgaaacgagtatatctggcctgtgtacgcggtatcgactttctaacttccctaccggaatgggatggcaaaaatgtaatcgcacaaggaggtagtcagggaggcgccctggcattaatcgctgccggactggatgaacgggtgacagcttgtgtcgccaatcatcctgcattaagcgatatggcaggctataaagccggacgtgccggcggatatcctcatttcttcaggaattcggtagatatggatactcctgaaaaaataaagacaatggcctattatgatgttgtgaactttgcgaaattaatcaaagtagatacctacatgacatggggattcaacgatgatgtatgtcctccgacaaccagctacatcgtatacaatgtactaaactgtccgaaagaagcactgattactcccattaatgagcattggacttccaacgataccgagtatggacatctgctttggataaagaagcatttaaagtgaagttttaatcattccatctggatgcgggcaattcttttttcccgtaaccttttttccaggcatacgctttcctcttcctgagataaagcgtatcgccacaatgtttcatcgcctcccaattaaagatagaatggtgacagatgatcttttcaaaccaataaagtatgtgataagtcacgaatggtaacaccatccaccaccatgaaagcagtaacgataaaataagtgctggtatcagggttaaagaaaaacattcccaatactgtctggcatgaattcggagttccatatcttcccagacttccagatatttatagcgggtaaagaaaaaccagcctaacataaaatagtgcttcttcccttttcctaagaaccactttgctaaaagactattataaaaaatcatattcacattttttttgttgcatgtagtcccttcttaacagcaaaagtaattaaaggttcaatattttaaagttttgcataacaaccataacattctttccctaaatatcactcaaatattgtttatttttgtgttcccttgcttcactacaacaaaaggtttatttgtattttctgcaaaggaaacacaattcacgaatatatcctaatttttctgcttaatatttaaagctgcttcctcctaaaaattcacgcaacaaagaagtaggcggaatttctttatcctgtaccggaacaaaatatttgataaacttcaacaatcggtaggcttcacaatattcaggacagttacgcggaacacccatcagaataggctcggcgtgcaaacgaagtacggcaaactcaaaaagtagcgctgaattaaacatgacatcagcattttcctgataagggaatatccatttgtcttcaccggcacgtacactaggccagcgtgatatggtttcacgtgcagaatatccccgataattaaagtcgcggatgatgcggcgcaacaaacggttgtcagtagttggaatccagttatggtcatccaacgaaatagtggtcaatgctgaaacgtaaatcttgaatttccgttcggctggtatatgcggtgtcagttccggattcaaggcatgaataccttccagaatcagaattgtattatcttctattttcagtttatcacctttatattcctttttgccaagagagaaattaaaacggggcaattccacctcctcgccacgaagaagcgcctgcagctgttgattaaacaattccagatcgagtgcataaagtgattcataatcatagtttccgttttcatccaaaggggtttcttcacggtctacgaaataattatccaaagagatcgggaatggcttcaagccatttgtcatcagctgaatagaaagccgtttgctgaatgttgtctttcccgaagaagacgggccggcaatcaataccagttttacccggttgccgttttcaccacgatggaagatagtatcggctatctgcgctatctttttctcctgcaatgcttccgccacattaatcaagtcagtggcatgtccttcttcacaggcaagattaaaatctccggcattattaagccccatgatataactccagttcagatattctttaaagacatccagcattttttcctgcttcacaacttcttcgagcatacttgggttttcacgactcggaatccggagtagcaacccgtcataatacttcacgatatcgaacaatttaagatatccggtgctgggaagcagattaccataataataatcaattgtatcacccaatgtataataataggtataaagagaaccggaagtttcaagtaatctcactttatcattcatcccccgctcgctgaaaacccgtaccgcttccgccgtatgacattcaatacggtgataaggaatattttctgcaatgatctcctgcatccgttgcttgatacgcgtcacatcttcgagttcaatggggcgtccaatccgcaaattgcagaaataaccttttgaaacaggatgttccacaaacaattttccctcgggaaagagttccgtgacagccttaaacaagacaaaacaaagcgaacggacataagtacgcataccggactgatctctcacatccagaaactctacatccttattattatatactctgaaattaagtccctcggagcgattattgaccttggcactcactacttgataaggaaaattaagattaaaaccgtaataaatatccaaaagtgagcttccgatagggaattctttggaattattgttatttttgcaacatatttgtaacatctgtttcatcgagttcgttaaaaggtgaataatttgggactaatatacttataatcagattgagaacaaataaccattaaaaatattatagatggaatattctttttatgattttttaaagctcataggctcattgggactcttcctctacggaatgaaaatcatgagcgagggcttacaaaaggtcgcgggtgatagattgcgaagtattctaacggcaatgaccaccaaccgggtaacgggagttctaacaggagtgttgattacagcccttatccagtcttcttcagcaacgacggtgatggtcgttagtttcgtgaatgccgggttacttacacttgccgaatccatcagcgttattatgggtgccaacatcggtactactgtaactgcctggatcatttcaattttcggatttaaggtcgatatggctgctttcgctcttcccctcttagccattgccctcccgctcatcttttctggaaaaagcaaccgcaaatccatcggtgaattcatttttggtttttctttccttttcatggggctctcttatctgaaagcaaacgcccccgacctgaatgccaatccggaaatgcttgccttcgtacagaactacacggatatgggattcttttccattattctgttcttgctcatcggtacaatattgaccatgattgtgcaagcctctgcagctaccatggcaatcacattaattatgtgtgccaacggctggatcagcctggaactgggagcagcactcgtattgggagaaaacatcggaacgactatcacggccaatcttgccgcacttacagccaacacacaggctaagcgggcagcattggcccattttgtttttaacgtgtttggggtcatttgggtattgattgtcttccatcctttcatggatctagtaaactgggtagtagacaccttctttcaaagcagtaatcctgaggttgctatttcctacaagctatctgctttccactctatcttcaatatctgtaacgtatgtatcttgatatgggcagttaaactgattgaacgtaccgtatgtgctcttatccaccccaaagaagaggacgaagagccccgtttgcggtttatcaccggtggtatgctttctaccgctgaactttctatccttcaggcacgtaaggaaatccatcttttcgcagaacgtacccaccggatgttcggcatggtgcaggatctgttgcatacggaaaaggatgacgatttcaataagctgttcagccggatagagaaatatgaaaatatcagcgacaatatggaacttgaaatagccaactacctgaatcaggtgtccgaaggccgtttgagttctgaaagtaagttacagatacgcgccatgttgcgtgaagtgacagaaattgaaagtattggcgacagctgctataatctggcacgtaccatcaaccggaaacgtcagactaatcaagactttaccgagaaacaatatgagcatattcatttcatgatgaagttgactaacgatgcacttgcccaaatgattgtggtagtagaaaaaccggagcatcagagcattgacatcaacaaatccttcaacatcgaaaacgaaattaataattatcgtaaccaactgaagaatcagaatattctggatgtgaacaacaaagaatatgattatcagatgggagtttactacatggatattatcgccgaatgcgagaaacttggtgactatgtagtgaatgtagtggaagccagcagtgatgtgaaagagaaaagagcttcttaacagataaaataaagaataaaaaaggagaatcagtagtatcaatacatacctgattctcctttttatatctaatagtatcttttataaaatcaattatatacgtatgattcagccaaacgccagaacaatgtagattccggaacagtagttgtacgaagcacttttgcagccccgccttccgaggccggatttatattggcaaaaatattccatcccttataaaaagagcagttactataatagtatgatttgtcactgcctgtcaatgtaaaagaacggtcggcatactgataactcaccaatgtagcttttccggcagaagaccctttacctgaccagttggaaatagcaattcgccccacccttttatctccattaaaaacaaagaaatctcctaacgtcgccacaagagcgtccgcatcatctgaggttccggtccagtaaccacccataccattacgctggtctactgtctgaagcttttccgaagaaaaactagtgggaagtgtcattactatttgcccgttctcataaggaaagctaagagtctcaatcacttgccaatcaacacccgtcactttcacctcaacccggtcaaatgtgaagtccgcaggtatattctgtatatcttttactacaagcgtgctataattcggaacatccggagcaggaggttgctcttcattctcatcgtcgctacaaccagccatcaaaaggctgaatatcaataatacaaagattacagggtatgatagataccttagatcggttatgacggttgctctattatacataacttccgttttttgcatcaaagatatcacatttataatcagcagaataatttccaaccataaaaataaaaaatgaccgggtatatatttatacacccagtcattctcctcttaataattctctctcttggttttatccttcgtacggttcaaagtcttcttttccgactccacataatggacaagtccaatcatcaggaatatcttcaaatgctgttcctggttcaattccactttccggatctccttgttcggggtcgtaaatatattcacagaccgtgcaaatgtactttttcataacgttcgtatttttaattggttttctaaataatataacacaaatagcaagatatttgttcaacactatttttaaactaaagaaaaaaactatctttgtagtcatattatcaagctaaaacaacaatattatactatgcttatagcactattgtctaccttaatagttttatgcgcagtcctactaatcagttttttattggaacgtaggaaatgtctgcggatgcaacaacgattgttccgtgaatccagaaagttggaacgcaccagccatattgccggcgccatcttgaaaaatgtgcatgcctttatcctattaatagacaatgatttcaaggtactgaaaactaactattaccaaaaaaccggaaccagaaaaggaacagaagagaaaagagtgggcgacttgttgcaatgtcgcaatgcattggcagccgaaggaggttgcggcacacatagtttctgcggttcttgcccgatacgtaccgccatacgacaagctttcgaacagaggcgaaacttcacggatcttgaagccactttatccgtagttacatctgataatactaccgtggaatgtgatgcagtaatatccggttcttacttccttctgaatgaagaagagaacatggtaatcaccgtacacgatgttacccgccgaaaacaagctgaaaaggagttacggctagccaaagaaaaagcagaaaaagccgatatttcaaaatctgcctttttagccaacatgagccatgaaatccgtacccctctcaatgctattaccggatttgcagaggtattaggcagtgcaactacagaagaggaaaaggcccaatatcaagaaatcataaaaatgaatgccgacctcctgatgcaactggtcaacgacattctcgatatgtcaaaaatcgaagccggaacattggaatttgtgcagacaacagttgacgtcaatcagttactttcagatttacaacaactttttcaaatgagagtcgatgacgccggaggaaatatacaaattatagcggaatcatcccgttcttcctgcatgattcaaacagatcggaaccgagtggcgcaagtgctttcaaactttgccggcaacgccattaagttcacccataaaggtagcatccgcctcggctatgaagctagagataccgagctttacttttatgtcaaggataccggaaccggaattccagcagagaaattaccggatgtattcgagcgcttcgtgaaactgaataaagataaaaaaggagccggactgggactctccatatctcaaactattgtcgccaaacttggcggtcaaatcggagcgaattccgtagaaggtgaaggctctacattctggtttacaattccttatcggtcatgtggtaaaccacgctaacaaattcgacttcataaaaagttttaattaaacattctatcacaattttatgttgtatttttgcggttcaaactaaacgcatgtatctgcatgagtacaaataaaaatgactattatcatttaggacttactgatgacgaagtcctacaaagcagggagaaaaatggtattaacctgttaacgccccccaagcgtccttctctctggaaactttatctggaaaaatttgaagacccggttgtccgtgtattattagtagcagccgctttctcattaattatctccatcatcgaaaacgaatatgccgaaacaatcggaatcatagccgctatcttattggctaccggaattggtttcttcttcgaatatgatgccagtaagaagttcgatctgctgaatgcagtcaatgaagaaaccctggtaaaagtggtccgaaacggacgcgtacaggaaatccctcgtaaagacatagtggtaggtgatatcgtcattctggaaacaggtgaagaaattcccgctgatggagagttgctggaagctatttctctgcaagtgaacgaatccaatctgaccggagaacctgttattaataaaactattgtagaagctgattttgatgaagaagcgacttatgcctccaatctggtgatgcgtggcactacagtggtggatggacatggtaccatgcgcgtgctgcatgtgggagatgctactgaaatcggaaaagtagcccggcagagtacagaggataacctcgaacccaccccgctgaacatacagctcaccaaactcgcaaatctaatcggaaagataggtttcaccgttgccggtctggctttccttattttcttcgtgaaggatgtagtgctatattttgatttcggttcgctgaacggatggcatgagtggcttccggttttcgaacggacactgaaatattttatgatggcagttacgctgattgtagtagctgtacctgaaggattgccaatgagtgttacgcttagtctggcattgaacatgcgtcgtatgctttctaccaacaatctggtgcggaaaatgcatgcttgcgaaacaatgggagccatcaccgtgatttgtacggataaaaccggtacactgactcaaaatctgatgcaagtgcacgaacccaatttctatggtataaaaaatggcagtgacttgtctgatgacgatattagcgcacttatcgcagaaggaatcagcgccaattcaacagcttttcttgaagaatcaaccaatggagaaaaacccaaaggcgtaggaaatccaaccgaagtggctttattgctctggcttaacaaacagggaagagattacctgcaactccgcgaacaagctcatgttctcgatcaactcaccttctctaccgaacggaaattcatggcgactcttgttgaatccccattgatcggaaaaaaaatactttatataaaaggagctcctgaaattgttttgggtaagtgtaaagaagttgttctggatggacggcaagtggatgcggtagagtatcgttctacagtggaagcacaactgttgagctatcagaatatggctatgcgtacacttggatttgcattcaagattgtcggagaaaatgagccgaacgattgcacagaacttgtttcagccaacgacctcaatttcttgggagtggttgccatctccgacccgattcgtccggatgtacctgctgcggttgcgaaatgccagtctgcaggtatcggtatcaagatcgtgaccggtgacactccgggaactgccacggaaatcgcacgccagataggtctttggaactctgaaactgatacggaacgaaatcgaatcaccggtgttgcatttgccgaattgagcgatgaagaagcactagacagagtgatggacttaaaaatcatgtctcgcgcccgtccgacagacaaacaacgtctggtacaactgcttcaacaaaaaggagcagtggtagcggtaaccggagacggaacgaatgatgccccggctttgaatcatgctcaagtaggtttgtcaatgggtacaggtacttctgtagctaaagaagccagtgatattacattgctcgatgactccttcaacagtatcggaaccgctgttatgtggggacgttcactgtataagaatatccagcgtttcatcgttttccagctaacgatcaactttgtggcattgcttatcgttctgctaggctccgtaatcggtacggaacttccgctgactgtaacacaaatgttatgggtgaacctgattatggatacttttgccgctttggctcttgcctctattccacccagcgaaacggtgatgcttgagaaacctcgtcgcagtaccgattttattatcagtaaggcaatgcggtctaatataataggtgtgggctctatcttcctcatcgtattgctcggaatgatttattatttcgaccacagtacgcaaggaatgaatgtacacaacctgactattttcttcaccttctttgtcatgctgcaattctggaatctgttcaatgcccgtgtattcggtactaccaattcggcattcaagggactttccaaatcgtatgggatggagcttattgtactggctattcttgccggacaattcctcatcgtacaattcggtggagccgtattccgcacggaaccgctcgactggcaaacctggcttcttattataggcgtttcgtccacggtgttatgggttggagaacttgttcgccttgttcaacgtattattcacaaaaaagacagaaatgaaaagtaaaggaataaaaaaccttcttattgatttaggtggtgtacttatcaatctcgaccgccaacgttgcattgagcactttcagaagttagggctccaaaacgtagatgcattgctggatatccagaaccaggacggactcctgatgcaacaggaaaaaggattgattacacctgccgaattccgtgacggagttcgtaaaatgataggcaaagcagttagcgacaaacaaatagatgcagcctggaatagttttctggtagatatacccacacagaaactggatttattattaaaattacgtgagaaatatgtcgtctatttattgagcaataccaaccaaattcattgggaatggacatgtgctcatttgtttccttaccgcacctttaaggtggaagattattttgaaaaaacgtacctctcttttgaaatgaaaatggccaagcccgaaccggagatattcaaggcaatcatagaggatgccggtatcgagccgaaagaaacgctttttattgatgactctgaaatgaactgtaagacagcccaaaatttaggaatttctacctatacagcgaaagtaggcgaagactggagccatcttttcaacctcaaataattttagagatatgcagattatacgtgacacatcggcaattaccccggaaccctgcgtagctaccatcggtttctttgatggagtacatgcaggacatcgctatctgattcagcaagtgaaagagatagccgccgccaaaggtctacgctctgcattggttacttttcccgttcatccccgaaaagtgatgaatgtggagtatcgtccggaacttctgactacccccgaagaaaaaataagtctgcttgcagacatcggggtagactactgcctgatgcttgatttcactccggaaatttcccggctcactgcccgggagtttatgacacagttgctaaaagagcgttatcaggtaaaatatctggttatcggctatgaccatcgtttcggacataaccgcagcgaaggtttcgaggattatgtacgttatggaaaagaaattggcatagaagtaattcgcgccaaagcgtataccagcaatatagaaatagggaacgaacccaacattccggtgagctcttccctgatccgcaaacttcttcatgaaggagaagttagcctggccgcccattgtctgaaatatgaatatttccttgacgggatcgtagtaggcggctatcaggtaggcagaaagataggtttcccaacggccaatttacgggtggatgatcccgataaactaattcctgccgatggcgtatatgccgtatgggtaacatttgacgggaaaacgtatatggggatgctgaatataggtgtccgcccgacgattgacaatggtccgaaccggacgattgaggtgaatatcctccacttccattctgacatatatgataaattcatccggcttacttttgttaaacggacacgtcccgaactgaaattctccagtatcgacgagttaataacacagctccataaggatgctgaagagacagaaacaattcttaaaaaatagattcttatgcaaaagtcatttatgagcatctctttggtggtaatagctatatccatgttagctatgtttatctatagtttctttaccactaaataaaaaaacatgaaaacggctatcaaattagtattaatagaccttctcattgcgcagattattgctccaatcctgattatgattccctgtacgatctatttgttcgtcaccacgggaaatctggataaagtcactctgacgcaaatgattatgatcccggcacaactagccggtcagattatgatgggtatttatctatggaaagccggttatatcagtaaaaagaaggcaacatggttacctgtgtcagccccttatctggtctgtagtgccattgcaatcctaacttgcgggtttgcagtttcctcactaatgagcctgctggattggattcccaatatcatggaacaatctttcaacattctccaatccggttggggcggcattcttgcaatagccatcgtaggtcccgtacttgaagagttattgtttcgcggagccatcacccacgctttacttcagcaatacaatccgactaaagcaattctgatttccgcacttctgttcggtgtctttcatataaatcccgcccagatccttccggcttttctgatcggtatcctgctggcatggacttattacaaaacaggcagtctgataccttgtatactgatgcatgtactaaacaattcattgtcagtctatcttagcatcaaataccccgaagcagaaaatatggacgacctgattaacggtaccccgtatctcatcgtcctattcgggtcaatcctcctgtttatcggtatcatactgaccatgaaccacctgacttcccaaaagcagcaataaaaaagggaagtttttacttcccctctttcgctttgaatgctaatgcatacattcgtatttgttttaccatcgacagcaaaccgttgctacgcgttggcgatagatgctctttcagtccgatcttgtctataaaataaagatctgcatttaagatttcatcaggagtatgtccggaaaagactttaatcaacaaggcaataatcccctttacaatcaaagcatcgctttctgctttaaaaacgattttaccatccacatcatccgcttgaagccataccctgctctggcatccttcaatcagattttgttccgtcttatatttttcttcaagtggttcctgttcatttcccagatcaataagtaattgataacggtccatccaatcgtcgaagtcactgaattccgcaatcacttcatcttgtagttcattaattgacattatagtaattatttaattagacaatataccaatgtgcgaatagcagatgccgtatttaaaaccggcataccaatctatcaacaccttattatattatttctcaattctattatttctcattgtaaatcacttccaataccgtctgaccgactgctttcaacgtattcttatcaatatgttccatattgtcattgacagtatgccatgtcggggtaaaatcaccttcctgattgtagggaatgatatcgatcgttttaatacgtgccagacgatttatgaacagatggtcgtctgttacaaatcctccgtttccatccatgaaagtctttccgtaacccgctttctttgccgctttccaaaccttcttatttatgtccggagcaaattcttccgaatacccttctttcataaacacactgccttcacctcctaccatatcgagcaggataccaaaacgtgcattatatccttgtacatgaggattacgtgcccaatactgcgatcccagacaccagaattcctccttatgctttcctgtataaaactgtggcgcaccgtagtcctctgcatccaacagaatgatatcaatccccaattccggttgttgctgattgaccagacgagctatttcgagcaaagctcctaccccactggcaccatcatttgcacccagaatcggagttttatggttcttctcgtcaggatcgttatcagcccatgggcgtgtatcccaatgtgcaaacaaagcgattctctttttactttccggcttataagaaccgataatgtttctcgctttcaacaacgtaccgtcataagcaatcaaatcagcatattgattagtcacttgagcaccgaaagcctctaattgactggcaaggtaattgccacaggcaacatgttctttagtgttaggaacacgaggtccgaaatctacctgattctttacatacaaataagcactatccgcatcaaactgaggtacattcacaactgtcttttcgtcttgttcactcgtactatttgccttgttacctccaccgcaagagaatgctgataataacaaaaaggcactcattaatactatcatagttttctttttcatcgtccttttatctattaaagcctcaaaattagtcattttcaccacagcatcgttcagatggaatggattattaacatataaactttagttccacatttttctttcccaccacaagctctacttttgcaccgttgataagcgggagattatgagtcacatgccccaccgggaaattgaaacagacgggataatcatactcttttactaaatctgccaaagcagcatacagttccttgcccaacgaacagtcttcttcatattctgtaaattgaccgataatcaatccggacagtttttctaacacgccccccagtttcaaattatacatcatacgttcgatggcatgcggacgttcgctaacatcttcaataaacagtatagtgccttccgccggaatatcataaggagtgccacgcaaaccgtaggctaccgccatgttaccgccatgcaaaacgccttgtgccgtcccctgcttgttcagtttatgcttctcgcacatgtaagaaggaatatttcccaatagaatatccttcagatagttcgcacaaagatcgtcttccggttccaccgtaagatgacgtgccatcaatgaatgaagggaagcatatccatttttctgaaacagattgtgcaaagcggttatatcgctaaagcccagtaaccatttcggatgttcacaaaaggccgtaaaatcaattttatcgatcaaatgtaccgccccgtaccctccacggctgcaaagaatagccttcactttagggtcgtccatcgcatcctgcaaatctttcagccgctgcttgattgtcccggcatatcttccggatgaacttccggcatgctttcctatagccactttcaagccccatgattccatccgtttcttggctccttttaggaattgttggtctatcttactcgaaggtgatacaataaccactttatcacctttctgcaaaaagggaggaaattgaatatccatatatgttcttattttattgactttcgttgataaaaacgcacccagtccacttccatttctaccggaagatcctcgggagagactgctcccacccacgaacctcccaactgcatatcaatcagcagataaaagggctgattaaaagggaattgtccttcttctttcgtttgtatgcgggggtaagtaaacgtatgtacatcattgacataaaatgaaagactatccggatacatttcgactgcaaaaatattgtagcggtcagggtgaatcactcccgtagaatgtgataccggatgatccttgatccccagcgtataagtgtaatgggaatgaactgtctgataagcaatagaatcgttattcaaacgttccatgatatcaatctcaccgccggatggccatgccgctccttcaggcaacatccagatggcaggccatgctcctcccgccgcattcaacttggcacaaatctcaatacgcccgttcgtaaaagcctttttgccttttgtatacacaccgcctgtcaaataaggggcagtgtcattgcgttgggtatgattgacaatacctctcaacaccagtttgcctttacgcatggcatagcaggaatcaaagtctgtcatatagttattccagtctgacttacctcgtggaatcttgctccagacctgtgaatcgaaactctttttctgattaaagttctcttcccagatcaaagaccaaccggaagacgtcttgctgcttttacaggaaacaagcgtccaacaaaggagaattaagctaagaaataatagatttttaaactgtttcatggtgcttttattttattgggggatttatttgcaaaaatacaggaaaaaacggttccatgcacatccaacagccaaaacaaataaaatatagcaaaatgttacataatggatgtaatttttcgggttataatcattattttttcaatcatttttctgatatttgctaaaaatctaacgttatggaacctattctaaattttgcccagttaacggctcatcttaaaaaactaaaccatagaaaacgaattgccgtggtctgtgcgaacgatcctaacactgaatatgccatctcccgtgctttggaagaagggattgcagaatttctgatgattggagattctaccattctgaagaaatatcccacgctcaaacaatatcctgaatacgtaaaaaccatccacatagaaaatccggatgaagcggcgcgcgaagctgtccgcattgtgcgtgaaggaggagcggatattttgatgaaagggattatcaatacggacaacttactgcatgccatactcgacaaagaaaaaggtttgttaccgaaagggaaaatcctcacgcatctggcagtaatggaaattcctacttaccataaactgcttttcttctcggatgccgccgtcattccgcgtcctactttacagcaacgtatagaaatgatttggtatgctatctgcacctgccgtcactttggtatcgaacaaccgcgtgtcgcattgattcactgcacagaaaaagtgagtgccaagttccctcattcactagattatgtgaatatcgtagaacttgccgaagcgggagaattcggaaatgtgattattgacggcccgctggatgtacgtactgcctgcgaacaagcaagtggtgatattaaagggattgtatctcctatcaacggacaggcagatgtcttgatattcccgaacattgaatcgggtaatgcattctacaaatccgtctctttgtttgcacaggcagaaatggcaggattgctgcaaggtcctatttgccctgtagtacttccatcgcgtagtgattccggcttgtccaaatattacagcattgcaatggcatgcttacaagtgtcaggagattgcaaatgcagaaaacaagtcagccaagtcaccggctcatcattctaaattcaccactaaaagcctactattcatgaaaattctggttatcaaccccggttctacttctactaaaatagcagtttacgaaaatgaaactccgctgtttgtcagtaatataaaacattctgtagaagaactatccgcttttcccgaggtgatagaccagtttgaattccggaaaaacctggtgttacaagaattggaaaacaataagatacctttttcttttgatgcaatcatcggacgcggcggtttagtgaaaccgataccgggcggagtgtatgaagtaaatgaggccatgaaacgtgatacagtgcatgctatgcgtacccatgcttgtaacttaggaggattgattgccagcgaactggcctccacattacccgactgtccggctttcattgctgatccgggagtggtggatgaactggaagatatagcacgcattacaggttctcccttaatgtcgaagatcaccatctggcatgcattaaaccagaaagcaatcgcccgccgctttgccaaagagcagggaacccaatacgaaaatctggatttaattatctgccatctgggaggtggcatctctgtcgcagtccatcaccacggacgagccattgacgccaacaatgcattggacggtgaaggtcctttctcaccggaacgtgccggtacacttcccgccggtcaactgatcgacctatgttttagcggtcaactcaccaaagacgaattgaaaaaacgtatctccggacgcgctggactgaccgcccatctaggtacaaccgatattcccgccattatacaatctatcgaagaaggagataagaaagcggaactgatactggatgccatgatttacaatgttgcaaaagcgataggagccagtgccaccgtactttgcgggaagatagatgccatccttctgacaggaggtatcgcctattcggactatgtgatttcaagactgaaaaaaagaatctctttcctggcccccatctacgtttatcccggagagaatgaaatggagtcactagcatttaatgccataggagcactaaagggggaattgccgatacaaatctataaataggcgggcgcacaaaaaggctattcagttaccaatcaccaagcaatctgatagtttctgtttctaattggaaacggctaactgtacagcatcattcacaatgcctgctaatataaagtcttgagcacataaatggttcgaccaaaaagaacactaatacaaataataacagtaaggtatatttgtctatttcacatagatagttgaataacatagtaaaaaagtacttttgcgatagtttctttagcggggttaataaaaaaagcgcctattagccatcgcattaaccacgattttaaccacgaccttaaccacgaagctatacctttgccatgtctcaacccgtgggaacattcaacattggcaacacatgaaaacgctgtgattacttcgcaagctataaactcaaaaagaaaattatgaagaaatgttggttattatttttagtgcttagctgcacgcttcttgcccagtccaaagactggacacaatacgttaatccgttaatgggaacacaatcatcttttgaattatcaacaggtaacacctaccccaccattgcccgcccttggggaatgaatttctggaccccacagaccggaaaaatgggagacggatggcaatatgtctatacagccaataaaatccgtggattcaaacaaactcatcagcccagcccatggataaacgattacggacagttctccattatgccgatggtgggtaaacctgaattcgacgaagaaaagcgggctagctggttcggacacaaaggagaagaagcaactccttattactacaaggtgtatctggccgaatacgatattgtcacggagatgtctccgaccgaacgtgctgttctcttccggttcactttcccggaaaacgcacattcgtatattgcagtcgatgcatttgacaaaggttcttttattcagattatcccagaagaaaacaaaattatcggttatagtacacgcaatagcggaggagttcccgaaaacttcaagaactattttattattcaattcgataagcctttcacctataaagccactgtaaataatggaaatattcaagaaaatgcaaccgaacagacaactgaccatgcaggagccattataggttttaaaactcaacgtggagaacaagtacatgcacgcatcgcctcttcctttatcagcttcgaacaggctgcaagaaatatgaaagaattaggaaatgacaatctagagcagataaaacaaaagggacagaaagcatggaaccaagtactgggaaaaatcgaagtggaaggaggaaacctcgatcaataccgcactttctactcctgcttataccgttcgttacttttcccccgaaaattctacgaactggacgaagccggaaaacctgttcattacagcccttataacgggcaagttctaccgggatatatgtttaccgacaccggattttgggataccttccggtgtcttttcccattactgaatctgatgtatccgtcgatgaataaagaaatgcaggaagggctcatcaatacctacaaagaaagcggattcttccccgaatgggccagccccggacacagagactgcatgataggaaataattcggcttccgtactggcagatgcttatttaaaaggtattaaagtagaagatgtgaaaactttgtacgaagggttaatacacggaacaaagaacgtacatcccaccgtatcttccacaggaagacgcggatacgaatattataataagttaggctatgtcccttatgacgtaaaaatcaatgaaaacacagccagaactttggaatatgcctacaatgactggtgtatctatcaattagccaaagaattaaagcgaccggaaaaagaaatacagctctttgccaaacgggcgatgaactataagaatgtattcgataaagactccaagctcatgcgaggaaaaaatgaagatggaacattccaatctccattctcaccattgaaatggggagatgcatttaccgaaggaaacagctggcactactcatggtctgtattccacgatccacaaggattaattgacttaatgggaggaaaagatatgtttatcactatgctggattctgtattttccgtacctcctgtctttgatgagagttattacgggcaggttattcatgagattcgtgaaatgacaatcatgaatatggggaattacgcgcatggcaatcaaccaatccaacacatgatctacctatacaactatgccggtcaaccctggaaagcgcagtattggctacgccaggtcatggatagaatgtacacaccgggccctgacggatattgtggagatgaagataatgggcagacttcggcatggtatgttttctccgcattaggtttttaccccgtatgtccgggaaccgacgaatacgtcgttggagctcctctttttaaaaaagcaaccttacatcttgaaaacggtaacagcctcatcatccatgcaaccgataacaacaagaagaatatgtatattcaaacaatgaatctgaacggcacagaatataaaaagaactatctacgccatgaagacttattaaaaggaggaaacattaacttccaaatgggaagccagcccaatttaaacagaggaacggaagaggaaagctttccttactccttctctaaagtcctaaaaaagattcgttaaattcataaaaaacaagagactgtttaactaagtctcatgttgataagtttgcctctattatgggaatccatagcagaggcaaattttattcttcaagacttattagggatattcattaaaaggaaaaagtgatctccttattcatcaacgtttcaaaaatcagaaaaagatagaggagccacacaccttatagcaacatgtatgctacttctcttaagaaagagtaacttcttccaataaagcaagctcccaactacgccaaacaatagtaattaacttcagttcacctttcgccctggcttctgccaccagttcatcttcactataacgaagtaactgttcgcgcgcctcatcagcaagggcacgtatttctttttccgaagcaccggcttttgcatatttcacctcaagcagataggtgaaaggaggcagtacaggaaccgacggactaggtttgaagaagaaatctgcaaaacccttattcaattcgtattccggatagagctgataataacgatacattcctaaataggcaagcaagaagcctttaatgtgcgcttcaccttcaatatattcacggatacgactttgctcacgaacagcattggcgataaaatcgaacaaaggtttccagtctcccctgaaagccatattctcaaataaagcactcatcctgttcatgtcaattttaaagatatcatgcttgatgtagccttgtatcaagaaattaaacagttgttctcttacaaccaaattcggtacatgtaaaatgggtcttcccaccatgtccacacctttgatggaaagaagtccgaaatagaataataaagacttgaaattactggggtccgtcatctccaatgcagagaaatgagtaacgatgtcagtagtgatttctccttgctcggctatttcctttataacggaaaaattctctcccaacccgtgatctagctttatcaagtatgccaacttgttaaagtcagtgcgaatattgggatctacgatttcttcaggcttttccccatgtaaaacaaaagacttcataaaataaagtaccatatcagagttaaacatacagtccaccaatctacttctactaaagcaataattgtcataattaggtttcatcatgacaacagtttcatctacagattgtatcaacactccttgttctttataataagtcagcatttcacgcaattctttctcactaaaaccaactaaatcattaaaccaaggatcagtcgttatattggttccgatgttaaagccactagtcacatcatccatcgtcaccggactcactccggtaataaacaaccgttcaagagcagctccggttccggtagtagcggattttatcacgttaaagaagccacgaataaaaccttcgccatgcgttgctttcctataaaattccgtaccgtaagtcgaaagaatggtattggtgaaattatcatattcatcaatgagtaaataaatacgaatatttttcttacgggtagcataggaattaatcgcagacagaaaagcaccgggttcttcttgtattttctcatcaagaacatcccaaatttcttttcctaacaaatcttcatacttaaagacaaaatctttaagtttgctacaacaatgcagcttaaacgatagttctacttcattgacattggaactcacttccgaaaaattaaatcgcatgatgagaaactgattgtggagcttcgtcggatgctgacctatgtatagctgaccaaacaactcgtcaaactgttcagcatgatttacgtcataataggcctctaacatagccaaagtcagactcttcccaaatctacggggacgtatcagaaacagataaggcggttgcatctctattttttcaatgaacattgtcttatctacataataataattctctttctgaattcggctaaaatcagttattccgtaaggtatttgtttcatcatattgcgattcctttcaatttatctgtcccttatttctgcagacttttttcaatattctgcaaacggcgttctaacgcagcatacttttcatccttttcttttaaaagacgctcgtagagttcagtgattttgtcgataggattgaagttgttaactcgactatcattaatactatcttcggtatcagacttaactatacccatgctgatgtttgccccacctgcactttgttctgaattattcaccgtattattttcaaacaccaccgtctgtgcatcctcctccaaagtcttgagataatcgaaagggacattcaatgcacgtgcaaaacgttgcaacatctcatcatcaatcactttcatcttctcatatttagaaacagcaggttgtgagagatgtactaattcactcaaaccctcctggttcatatccttttcaatacgggtacgacgtatattgcgtccgtgatggactctcccaattgtcaattcttctgtttccatttttattttctttctttttaaaatccaacaaatatacaaatgaaaagtttcgctcgaagcaaatatacgaaaaaaacgaatagatgtgataatatggataaaaggaatattacaacctgacaaatagaataaaatgaatacttcaaacagcgcataatgtgttaaattatcacgaactttaccgcacgaaagggcaacaaaacaaaagagcttacggacatgaaaagaatattgacaaataaagaatacaggttcataaaagggctcaaagaattgatgattaaatacaatgcggtgatctctacagatgcgcaagggaaaattgagattgtggtgaatgaagacaacgaatcatttgattttgaagcagaaagcacgatctatttaggagcttgtttttcagattatgagttaaatgaattactggaaaagaacttcgcacacataaaacgaataaaagaggagtataaaacaaacttgtaaacggatctatataatcgaaaaatcattaatcctaatctctatataaacaccccaccggtttctttaaaaccaacgacctcttccttttaaaggaaggggtcgttcctttaaaaggagtgaagctttggttttaaagcaagaaaaacgaccttattaacaggtatatttgcctgtatcataaactttttaaataaaaaagctctttcaaagaaatttttctcatatctttgcgacgtgttaagttaataaattgattaaggtcgatttttgactgtttcgaatcgggaagtatgggggtactttccgattctttttttggggaggatataacaaggtgtctttcatctttttaaaggttttaataaactgaataaatctaatatatactaactctatatataaaacagttcaaccccggatgatactaataaaaaaagaaggctgtttcaaaattgaaacagccttctttatatatagacgctatcgcgttcttatttcttttctggtcttggcatcaacacttttcttgaaagtttgaatttaccagttttctggtcaacatcaatcagttttacttcgatttcatcaccttccttaattccagcttcttctactgtttccagacgcttccaatcaatttcagagatgtgcagcaaaccatccttgcccggcaagaattcgatgaatgcaccgtaaggcataatagaacgaactttacctttataaacttcgcccacttcaggaacagcaacgattgctttaatcatgcgcattgcattatcaatacattttttgtttgttccggaaacttcgatgcgtcccataccatcaatttcttcgatagtaatcacagcaccggtttcttcctgcataccttggatgatttttccaccagggccgattacagcaccgataaattctttaggaattgtcatcgtttcaatgcgtggagcatgttctttcaggtcagcacgtggttcagcgattgtttcagtaatcttacccagaatgtgcatacgtccttcttttgcctgattcaaagcacgttccagaatttcgtaagacagaccgtctaccttgatatccatctgggtagccgtaataccatcttttgttcccgttactttgaagtccatatcacccaagtggtcttcgtcacccagaatatcagacaatacagcatatttttcttcgcccggattcttaatcaatcccatagcgatacctgataccggtttcttgatcttcacaccagcatccatcaatgccaatgttccggcacatacagtagccatagaagaagagccgttagattcgagaatatctgaaaccacacgtactacatacggatagtcagcaggaatctgtcctttcaaagcacgccaagccaagtgaccgtgaccgatttcgcgacgacctacaccacgttgtgcttttgcttcacctgtagagaaaggagggaaattataatgcaataagaaacgttcttttccgtgttccaaaacatcgtcaatgatcttctcatccagtttggtacccagagtaacagaagtcagtgattgtgtttcaccacgagtaaagatagcagatccgtgaggaccaggcagaggaccaacctcacaccagatcgggcggatttcagtagtcttacgaccatccaaacgcttaccttcgtcaaggatagaacggcgcatggcttctttttctacatcgtggtagtaacggtcgatcaacgcacccttttcgtccaactcttcttcagagaattgagctttgaattcttcacggatagcttcgaaagcagcaaaacgttcgtgtttgttattgtttccggaagcggcaacagcgtaagctttttcgtagcatgcttcacgaacagccttgcgcaaatcttcgtcgttcacttcatggttgtattcacgtttcactgtttttccaacctcttcagtcaactccatctgtgctttacaatgaaccttgatagcttcatgagctactttcattgcttccagcaattcagcttcggatacttcgtgcatttcaccttctaccatcatgatgttctcataagtagcggccaccatcagatccatatcagctttttccagttgttcaaaagtaggattgataacgaactgaccgtcgatacgtgctacacgtacttcagaaatcggtccgttgaaaggaatatctgaaacggcaagtgctgcagaagcggcaagtcctgccaatgcatccggcatatccacaccatcagcagaaaagaggatgatgttcacatatacctctgcgtgataattatcggggaataaaggacggagagcacggtcgacaagacggcaagtcagaatctcataatcagaagctctaccttctcgcttggtgaaaccaccgggaaaacggccgaatgccgcaaatttttctttgtactctacctgtaaaggcataaaatctgttccgggaactgcatctttagcggcacaaacagtagctaacaacatggtgtttcccatgcggagcattacagaaccgtctgcctgttttgccaactttcccgtctcgagcgtgatggttcttccatcaggtaactcgattgtcttaacaattgggttaatcataaaaattgttttatctatactttttctttcaaaattcctgcaaagatatacatttatcgtggtaattaggtggaaatgaggtaaaaagttagtggcgaactgattttttttcaaaattaggatgaagaacacagcaaaatgctttgactaatctcgaaaagaagtatatttgcatctcgttaataacacacactatatgaaaaaggttacttttgcagcgctcgccgcacttactattactgcttgtagttctggccctaaattccaggtgaacggggatgtatcaggagccgacggtaaaatgctttatctcgaagcttccggtctggaaggtattgttccgctcgattcagtgaagctgaaaggggaaggtacattcagtttcaagcagcctcgtcccgagtcacccgaattttaccgtttgcggattgacgacaaaatcatcaatttttctgtagattctatcgaaacaattcaaatcaaagctccgtatgtggatttctctactacttatacggtggaaggttcggaaaacagcaataagataaaagaactgacgttgaagcagattcgccttcaaaaagaggtggacaatttactggcatccctgcgcagcaacggaatagggcatgatgtatttgaagacagcctggcaacattgctcaacaactataaggaagatgtcaaagtgaactatatttttgctgctcccaacacggctgcagcttactttgccctgttccagaagctcaataattatctgatattcgatccgttgaacaataaagacgatgtgaaatgtttcgcagctgttgctacgagcctcaacaatgcgtttcctcatgcggtacgttccaagaacctttataatattgtaatcaaaggaatgaagaacacgcgtcagccgcaaacaaaagctctggaaattccacaggacaaaatcgtagaaaccggtattatcgacattgccttgcgtgatgtgaaaggaaatgtgcgcaagctgaccgacctgaaaggcaaagtcgttttgctcgatttctctgtattccagtcgcctgccggagctcctcacaacctgatgcttcgcgaactatataatgaatacgcaaaacaaggactggaaatataccaagtatctctcgacgcggacgaacactactggaaaacagcggcagataatcttccatgggtctgtgtgcgcgatggaaacggagtttactctaccaacgtagccgtatataatgttcgtcaggttccatctatctttttgattaatcgtaacaacgaattgaagcttcgtggcgaagacattaaggatttggaagcagctgtcaagtcattgctctaagttgttataatttagcatatttcatttaaatatgttacatagcatcttttttcacttgacacgtatcacttaaaaggctatctttgcaaagaaataatgaaaagagggttccaacatggctcatgttggaattcttttttgtttatatgaccatttaaaacaattaaaggaggaaaacatcatggcttatatgtcagaagaaggttacaagaaactgatggcggaactgaaggaactggaaacagtggaacgcccgaagatctctgcggcaatagccgaagccagagataaaggagacttgtctgaaaacgctgaatacgatgcagcaaaagaagcgcaaggtatgctcgaaatgcgtatcaacaaactgaaagctaccattgcagatgccaaaatcatcgatgaatctaaattgaaaacagattccgtacagattttaaataaggtggaactgaagaatgtaaagaatggcatgaagatgatttataccatcgtttcagaaagtgaagctaacctgaaggaagggaagatttccgttaataccccgattgcacaaggtctgcttggcaagaaggtgggtgatgtagcagaaattactgttccacaaggtaaaattgcactggaagtagtaaacatatcaatttaacgtaaaggcaggtctccatgtgaggcttgccttaatttatcaataaaagttatggcaacaatattcagtagaatcatcgcaggagaaatcccctgctacaaggtggcagaaaacgaaaagttttttgcttttctcgatatcaatccattggtaaagggacatacattggtagtgcccaaacaggaagtagactatattttcgatttgagcgatgaagacctggctgctatgcacgtgtttgcaaagcaagtagcctatgccattaaaaaagcattcccttgccaaaaggtaggcgaagctgttatcggactggaagtaccccatgcacatattcatttaattcctattcaaaaggaatcggatatgttgttttcgaatccgaaactgaaattgtcggatgaagaattcaagtccatagcgcaagcaatcaactcctctctataaaacatgatgatgaaataatgaaaggcattccgtgatggaatgccttttttctttacttttctttactttcggccacttcaaccaggtaaactccaatacagataaaaatgattgcaaatgtctgcgtccagctaaaacgatcttgtcctagagcaagggaagcaatggtcgccacaatcagaatcaaataaccatagatagcgactaccgtcgtcttcagatatttcaaaccgacaggcagcagcatataactgatagtggtcgggaaaatcaatacgaacatcagaataaggaaaggcgtccaatggaacggcatggagaataccggggcatcaaatcctgtaataaacgtgactataatggcagacacggcagcaccggaaaaggtatatcgcaacatcgttatcgctccaatggccgtgaggatgcgctgactaagaatcagatagacagcatacaccacagaacttagaagacaaagcatattccccgtaaaagcatcagaggccaaatcatcgctttgctgggttaggatgcaaaccaacgctcctatcagaccgatagaaattcctattatttttttagcgcacgccttctccttataaaagaatatcatgataagaaaaacccaaataggctggagactggtaaatatggaactggagacaggagttgttttactcaatccggccagatagagaaacataaaaccgtaaagtcccaaagcccccaacagaaagaggagccatttatctctggttgacgatttctccggaggcataaaccacccgatcacccaaaaagcagctgctgcaaatgtgcaacgaagcgtggctcctgtcaatggactcatccacaaaggcagaagatactttaaggcattcatatttaaaccgctaaatactttcgagacagccatactaagattggcttccagtttcttattcttcattttctattttaattggtcgttaaacaaaaaggtattacggcgccgatatgcccagaaaagagtaacaatagttatcagaagattaaagataaaaggaaactcctgtgattgggtatggaatatccactggaaaaaatcgacaataaagggataaagcaagatagccagataattcatcatcatcacaaacgccaaagccaatgtggtcttttgcggcagtgcggtctgggtggtcttatcataaagcataggttgaataatgccatatcccaaaccaaccaggatacatccgggaataatcagccattcgatcggagctatccagattaataacaatcccaatgccatcgacagcaggctgtatgcttttgtacgtcctttcagcagggctacaatcttgtccaggcaaaaacccggagcagtgatggccagaaagaaaagcgaaatcatcaatccggaattgccactggagaagtgatgcttttccattaagaaaggtagattgaagatcaccactaccacgatatatgttatcacgccatagaagagcatcaactctatcagatgtttgatgtgaataccgtacttgctgcctcctatatctatggaagtagattgttcggaggattcgttgtcttttgtagtatctgcagaagaagaaggtgtaaaagcgacttctcccgtccggtcttcttttaaatgtcctaccagcagaatggaaatcaatgggaggagatagaccaggaaaggcagatgccagctgacttctgcaagatagcccgttacggcagttgctatcactaatgtgaaattagtaatagcggagcttaatccgaactgtttcacccgataggttcctacaaagtatctggaaaccaacccggtagataaagggataatcagaccggaaccgataccgagcaaagcacttaccacaattaattgccacattcgattggaaatcagatacaaaataccgctcgcggcaaaaagccagagtccgacctttaatacacggacataatcgactttctctgtcagtttaccacccagcaatataaaaggaataatgagcagtgatggcagcgaagtcaacatctgtatgtccagatccgtagcttttggaaatatcttcgtaagatcacccaatataggtgaaacagccagtcccggcaatgaagtcaatgccgaaatagaccagatggcaattaaagtaataagaggaattgttccccgtcccgtctgtatcttcataatgcttattcgttaaaagtttaggtttgaagaaaacaatagttgctttataaagttcaaatatgcaccgaaatgagccaaatgaacatttattgaaacgcagattaacgcagattttcgcagattattagaaggctgcgccatgtttgagaacttttttattctttgcgaaaatctgcgttaatctgcgtttcaatacttatttgctaaaatatcaattgattcataaccgtgtgggaatgaactaatcttagttcttctaaaatttaattggtaatatgcgatgatttaatattcatcatacataaatttattcgtctgacagttgcagggcagacgcattaaaaattattttcctgtaaaagttgtgacaaatatttttcataataaagaaacggaaaaggagaatgtagtaaaaaatataatgcgtctgccctgaatgatacatgaatttattcgtctgacagctgtttctttttcgtctgacaattgtcagacgaaagaacaacaattgccagacgaaagttcaacaactgtcagacgaataaatctatatatgatgaatattaaatcatcgcatattaccaattaaatcttagaagaactaagattagttcattccagtaccgaaaggagctaaaacctgttcaccaccccatgataaaataacgaataatagcccatagttactaatcctctgccattctctgcttattttgttgggcaaactctgtaggagtaactccgaattgcttctgaaatatctttgcgaagtaagaaggcgactggaaacctactctgtcagagatttcgttgatgcgcaattctccctcctgcaatagttctgccgcacgttttaatcggatgatacggataaagtcgagtgaagaaagatcggtcagcgccttaatcttacgatgcaggctggagcgggacatattcatggctgcagccaatgcttccacattataattggcgtcggaaagattctcacgcactttggctatcagttgggacatcagttgttcatcagcccgtgacatcgcacccccttgcggagtacaagctccgtaagtgatctgattaataaacatctcatgcgtacgatgggattcacgctcacgcgccagttctgccaataattgctgctcacggatcttttgtacttcccggcggcgataggcgcgaagagtcaagacaaagctgccggacactacaatgatatagataaggtaagcccacactgtacgccaccaaggtggaagaatacgcactgataaagtagcttcttcctgattccagacaccattattattactgccccgcacacggaacaggtagtctcccggcgggagctgggcataagacgctgtatgcacatcagatgtataattccagtcattatctatcccttccattttgtaggcatagcgatttgcacccggtgaggtataacttaaagcaacaaaatcaaagctgacgttagaacggtaaggcagttgcacaccatccgccgtgaaaggagtttcacgtccctgcacgtacattccggtgatatagactggaggcacaaaagtattcgggtggacaatttgtggattaaaagagaccaatccattgatagttcccatccaaatagtaccatcagaggcagccaaggccgacttatagttaaactggttatcaggtaacccgtcatttcggttgaaaacttgcaggctgtctgtttccggatgaagacaaaccagcccacggtctgttccgaaccagatacgatgttgccggtcttccacgactttatatgttacgttgtccggaagcccgtccgctttggtgtatgtccggaatcttccggtttcggggttaaaacgcaacaatccaccccggtctgtagaaaaccagataaagcctttactatcctccgaaatacctgtcacttcatttgttccgatagaagtgctatcctccggtatacatttatagctgaccatctgatctgtctgcggatgataccggaatattccactgcccatcgttgccacccatatattgccggatttatcttcgagaatatcacgcatataagcatacccgaattgctccattttctcaaaagtctgtcctttgtcggccgaacggaagatgttccagccatcacccaaccagattgctcccccacgatcgcggtaaagggcaaacacggaaccttcactgataccaagttgtgcgggatagaacgtctgaacctgatcttgaggaacaatcaggtcaatgccccctttaaagtaacctgcgccaaccaaatcatccgaagcgaacaggcttaatacattctgacggtcaggcgactggggaattttagtgaaagtctgtgttcccggattccagtagcaaacaccgccatcctgtgtactaacccacaccactccgtcttttccttccgccaattcactgatgcgtcgtccgctgactgtaccgggcgctcccggaagataaaccgaaaaatcgagcgtacgtacaggcagatagctggctcctccaaattgcgtacagatccaggttcccccttcacgatcacgataaatcttatcgacgatagcatctccaagcccatacttccctccggcatcggcaggaatatgttgcacactgttgtgtttctcattaatcacataaacgccattctgcgtacccacccacagctcgtctccgaagcaaacagcgtagcgaataatttttcgatgtacttcgggcgcagggaatatactcacttctccagtctttttattgaaccgtttcagttcctcttcatgcactccgacaatcagttcatcgccataatcgcacagagtaaagatgaaatcccctttaagggcttctgttgcatagggcacaaacttatcctgctccggactgtaacggtaaattcccgctccatacgtacccacccagaccgtaccttctttatctacacagatagactgcggaaagtccttgcttttatccttactgggacagggaatatagcggaacagtttacccgtctccacctgatagcggaaaactccctgattcggtgcattcacccagatatttcctgaatgatctgccagaatatcttcaatccagttgtatctgatttgctctccgctctctgtgcgggcatcaaagaacgaaaacttcccggtagcaagctcttgaatataaacaccatcatccgtacctacccataattgacggtgattatcctcaaaaagagcggatatgacctgattgccatgctgcaaagtttcgtcatagcagttataaagcttcatcgacacgccgtcataacgattaagaccgttgcgcgtacccagccagataaaaccgtaactatcttgaataatggacttgacatgactgttcgaaagaccgcttcctccatctacacggataaagttatactgtcccgtcgcggcaaaatccggaaggaaaaaacaaatagaaaggagaaaaagcagcaatttccttttcatacacagatattagatagcgacaaatatagttttttttacgctaaatgcataggaaggatgaaacatttgttgcacggatggcaataaatgtcgcactgcaaagggctatcgcacacttgaaacatctcttgcacatcttgacaaaaaagagtatagccacttgtttctcctcctcctatctttgccttcgtcaaaatgacacaaccgatgtgaacttccaaatctttaaatgaatacaagtgatgaaaaaagtaacctttagttgccttactctagcaaccctgttgcaactgattccttccaacgggaatgcagcgaacattcaggtgaacaagaaaaagacgaaccgaaccgaaatgaagcaggatacgattcctgccaactctactaaaaaagaatcagaagaaggcgaacgcaatgtgatgctgaatgcttctgacgccaacaaaccccgcgaaattcaaatcggccttcccagcgaggacgttaatgtctatgagaatggacttcctgccgtatattcctctaccgttcacaaacttgccgctcattggcgtagcgacagcagcctgggagaagtaggacttttatctccttccgaatcggccatcacgaccggtaatattgcttactccgtcaactcattcagcaaactgggacaaaaggatttccaaggtatattaaactaccgcaccaatcatttcggtatgcagaacttcgacttcaatgtttcaggagccatcaataaccaatggctttacacggcaagcatttaccagaacttcgacccgggaagtttcgacctggaatttacgaactatgcagaccgcacagagatttatcatgccggcctgacccgtctcttcaacaacggacgcggcaaaatatctttgctctacaaacactcccgcagtgaaaatccggccagctatgccaatgcagctccttttatctatgtcggcgacggctcggtcaaagagatagacggtttcaaactgggaacaaattcttatgttccgcagaacggttcttttccatacatggacgtaagagacggaaagatgaaaacatggaatttgggcgatggttctgaaaaccgtgccaatgagattgcattgatctccgattatcgtttcaggaacgatctgctatggaaattcaatctgaaatatatggatgctccacgtgccaactatgtcgacttcggaggcagcaccatcagcgaagtaaccgccaacgatggttttacgctatcaaacggtgatccgtatgagggactggcagaaggtcgccgcacctggttgcacgtaggcaaagtgaaaaacttcctaatcacttccgagctaaacaagacctttggcaaccatgatctgcgtctgggagtgaacgaatggtattaccatcttgattattattcctcttctctgcaatggatggccaccgtacagaactatccacagttgctgacttccacaactacaagttccctggaccctactctgaccggtcagcgcgtacagacatacgggtacaacgaacttagtcccgaatatacaaagggatatgagaacaaactcgccctttactttacagacaactggcaagtaactccccaattcaatatctattatggcggacgcctggaatattaccggatgagtgccgatcaaatatccgcttcccgtttcccgggtttccgcatcggcgactttaccacttatagcaaagaggaagaaacaggaaatatcattgccacacaacgcagcattcatcccgccaaagtggtaaaggataaactgaactatgccgccacgctccgcgccacttacaacgtaaccgggcaattcggcctgactgccgacggaacagtagccacccgcttcccacgtatcaacgaatatgccggaacaggtcctacggaagagcaatacaaacgtgtcaccataccgttaatccgtggcggtttgttctacaagaacaagtggatcaacctcacctctatggttacctatatctctaaatctaataatattgaccagcaaaacctgacgaaaccgggaacggaagaaggaaagaccgtattgcttatttataatatcaaaacactgggatggaccacatctgccgaaatcgacccgttcaaaggttttcacctgcacgctctgttcacgtatcagaaacctgtttacaagaactataacgcaagcgtcacattcaacgatggttcggaaatgtctgtcaacgccaatgggatgattgtaaaagagattccgcagattcttgtcgaactcgacccaagctataatatcacgaaggacttacgcctttggcttagtttccgctatttcggcaagacttacgccaatctccaggaagccctctatttcaacggtcgctgggaaactttcggggggatcaactggaatgtaaacaagcatctttctttaggggcaacagtcatcaacttcctgaatcagaagggggccagcggaaccatcaacggttcggaactgattaccaaagaagaagctgcccagtatgcaggcaactatatgagtggaaattatttacgcccatttaccgtagaatttagcgcaagcattaaattctagttcattcctgacgaattataattatctttgcggcattctatgcccacaaactaactaatacctaattaattattaaaaaaccatgaagaaacttctcgtattacttatggcattgtttaccctggcgcaagtggacgcccaggaaaagaacgttatccgcatcgcaacggacaacacagacttaattctccaagtagctcctaacggacgactctatcaggcttatctgggcgataagttactgaacgagaaagacatcaacaacttttctccttacgtaaaaggaggaagtgacggtagcgtatccacccgaggatgggaagtatatccgggctccggcgccgaagattattttgaaccggctgtagctatcacgcacaatgatggaaacccaagtacgattctccgctatatatcctccgagcagaaggcagtggcgggcggaacggaaacgatcattcaactaaaagataatcagtatccggtagaagtcacactacattacatcgcttatccgaaagaaaacgtcatcaagacgtggagcgaaatcaaacatgctgaaaagaagcctgtgaccttatggcgttatgcttccaccatgctttatttctccggaaacgaatattacctgacagaattcagtagcgattgggcaaaagaagcacaaatgagcacacaacctctgttgttcggtaaaaaggtgatcgacaccaaactgggaagccgtgctgccatgcacacccacccgttctttgagcttggttttgaacaaccggcacaggaagcgcagggacgtgccatgctaggtactatcggatggacaggaaacttccagttcactttcgaagtggacaacgtaggtaacctccgtgtaatccccgccatcaatccttatgcatctgattatgaactgaagccgaatgaagtgtttacaactcctgaattcatctttactttcagcaacaacggtacgggcgaagccagccgcaaccttcacgcatgggcacgcaactatcagctgaaagacggacaaggcgaccgtatgactttattaaacaactgggaaaatacttacttcaaattcaatgaggaactgcttgccgaactgatgaaggaagctaaacatcttggtgtagatatgttcctgctggatgacggctggtttggcaacaagcacccacgcaacagtgacaatgccggactgggtgactgggaagtgatgagatccaaactgccgggcggtattcctgcccttgtacagtctgccaaagaagccggagtgaaatttggtatctggattgaaccggaaatggttaaccctaaaagtgagttgttcgaaaaacatcccgactgggctatccaactgcctaaccgcgaaacatattattaccgtaatcagctggtactcgatcttagcaatccgaaagtacaggactttgtatatggtgtagtggataagatcctgacagagaatccggaagtggctttctttaaatgggactgtaactctccaattacaaatgtttattctccatatttaaaaaataaacagggacagctttatatcgaccatgtacgtggtatatacaatgtattgaaacgtatcaaagacaaatatccaaacgtgccaatgatgctctgctccggcggtggcgcccgttgcgactacgaagctctgaaatattacacagaattctggtgcagcgacaacacagacccgatagaacgtctgtttatccagtggggattctcacaaatcttcccggcaaaagccatgtgtgcacacgtaaccagctggaacaagaacacaagcgtgaagttccgtacggatgtggcaagtatgtgcaaactgggctttgaccttggactgaaggaactgaatgcagacgaacagacttactgccagaatgcagttgccaactggacgcgtctgaaaaaagtgattctggacggcgatcaatacagattggtttctccctacgatggcaatcacatgtctctcatgtatgcctcaccggataagaacaaagctgtgctttatacctacgatatccacccacgtttcggtgagaaactgctcccggtaaaacttcagggactggatgcgaagaaaatgtataaggtgaaagaaatcaacctgatgccgaattccaaatcgaatctggctgccaatgagaaaacttattcaggagattatctgatgaaagtgggaatcaatgctttcacaacaaatcaggctttcagccgcgtaattgagctgactgctgaataaaaaggaaggaaataatcgataaaaaagggggattcgctgttatcagcgtttcccctttctttttacatacaataatattcaattcatcttcaatcgcaacagctgtttcaatggttacaactattctattagacggaggaagtctctaaaaaagttgcagctacaccgtaactttttacgatatagctgcattaatgttaaagagagagaatttatataatataagcatggtctcacgaccctcctgatattcaatgaacattttgtttctttacctattagacgcacgaaagctcaaatcactgcactcgaggccctctttttttagttaaagaataaaaaaagccgctactccacaggaatagcagctcatatctttaaaacatcttgctgacacgttcaattcctgccaccaaagtgtctatttccgatttggtattgtacatggcaaacgaagcacgtacagttccttctatgccaagacgttgcatgagaggttgtgcacaatgatgccctgttctcacggcaatacctagacgatccagcaacgtgccgaggtcgaaatgatggatatctcccaccaggaaagaaatgaccgctccccgttcggctgcttcaccaaatatacgtatatgggggatttctttcagacgttgcaaagcgtaagttgtcagttcatgctcatgggcggctatctgttcaatgccatgtccgttcacataatcaagggcttttgccagtccggtagttccgatatagtcgggcgtaccggcttcaaacttgaaaggaagttcattaaaagtggtcttctcgaaagagacatgctgaatcatctctcctcctccctgataaggtggaaggcgatctaaccattcttcttttccataaagtactccgacacctgtcggaccatatatcttatgggcggagaataccagaaaatcggcatccaactcctgtacatccactttcatgtgaggaatagactgtgcagcatctatcaggcaaggtacaccatgcgcatgagctgttgcgatcatctccttcaccggattcactgtacccagtacgttcgatacatgaactacgctgactattttcgtgcgttcggaaaatagtttttcatattcatccagcagaagttcgcctttatcattcatcgggatgacttttatggcaattcctttacgggcagccaacagttgccagggaacgatgttgctatgatgttccatcacggaaacaatcacttcatccccttcttccataaactcgtcgccgaagctggaaacaagcaggttgatactttctgttgttccgcgtgtaaagacaacttcattcgtgctatgggcattgataaactcacgtaccgtttcacgggaagcttcatgcagttccgtagcttgctgggaaagataatgtacgccgcgatgcacattggcattgacggaataatattcatccaccaacgcatcaaccaccagacggggtttctgtgttgtcgcaccgttgtcgaaataaaccaaaggtttaccgtaaaccgtacggctcaatatcggaaaatcttcacgtatcttttgaatatccacgttcattattttttagtggttacttacaaatggcacaaccctgacatctattcaactcgccacggaaacgtttctctactaatagatgcaaacgatctttcagcgcttccaaacgaatggtatcgatcacttcgttgacaaatgcgaacatcaacagcagacgggcttctttctctgcaataccgcgcgaacgcatgtagaataatgcgccttcatccaactggcctactgttgctccatgcgaacatttcacatcatccgcataaatctccaattgaggttgtgtatacattcttgcatcacgcgtagcacaaagattccggttagtctgttgggaattcgtatgttgtgcatcgggacgcacgagtaccaatccggcaaacgcacctaccgactggtcgtcgagcacatacttgaacagctcattgctggtacagttcggtacggcatggtcaatacttgtatgattgtctacgtgctggtttttatcggcaatcgccataccacaaaggtttatttcggctccttctcctgccagcaacacttcggtcgtgttgcgggtagtaccattatgcaaagtcattccgttgagcaatacattgctgttggcctcttgctttacatacaggttactgatacgaactgtgcttgtatgtgtttcttccagttcatacatatcgaataccgcattctcaccagcaaatacttcaataacttgtgtcgccaggaagttcacattatccattgcatggtcacaaatcagcaaacgggcttgcgcgccatcctccaggataatcagtacgcgacggttcaccataaagttaacatctgcacgcaggatatttaccaactggattgttttttccaccaccacattcttcggcacataaaagacaacgccatcttgtgcaaaagcggtattgaaagcagtcacaccatctttagaggtatctgccagttgaccgtaatatttcttcaccaattccgggtgttgctcggccacttctttcaggctaccgaaaatcacaccttccggcagatttcctgtgggaagcgctctattataaaatgtgtcatttaccacaaaatacaaggaggtactcatattcggcacatcacacttaaacacttcatacggattgaccggaatagccaaacgattcaagttcaaaccgaaatccggttcaaagtacttgctcacatccgtatatttgtacttctccatcttacgggtcggaaatccgagtcgctcaaaatcggcaaatgctgacgcacgaggtgcattcagcacttcggcactatgcttacagatcatcgcttccgtctgtgagaaaagttctatatattgttgttcaaccatcatcgttttatatttgtcattctcctacttctttcttgatccaatcgtatcctttttcttccagttccagagcaagttccggtccggcagtttttacgatacgacctttataaaggacatgcacaatatcaggcttgatataatcgagcaaacgttggtagtgggtaataacgattgtacttgtttcaggagttttcagcttgttcactccttccgcaacaatacggagcgcatcaatatccaaaccggagtctgtctcgtcgaggatgctcaaacgcggttccagcatagccatctggaaaatctcgttccgtttcttctcaccaccggaaaagccttcattcaccgaacggttagccagtttattatccaactccaccaccgcacgtttctcacgcatcagcttcagaaactcactggcggtcagtgcaggcagacctttatatttacgttgctcattcacagcagcacgcataaagttcaccatgctcacacccgggatttccaccggatactggaaactaaggaagattccttcatggctacgatcttcggggctcaactccaacagatcctttccataaaaagtgaccgaaccttttgttacctcaaaagccggattacccaccaatacggaggaaagcgtacttttaccggaaccattcggtcccataatagcgtgcacctcaccgggattcaccgtcaggttaatacctttcaatatctctttgccattaatgctggcatgcaggtcttttatttctaacatgattatatttacgattttacgatttactattaaaaagtcaacatcaccccacgcttccttccaatgagatggtaagcagcttctgtgcttctaccgcaaactccatcggaagtttattcaacacttcctttgcatatccgttcacaataagtccgatagcatcttctgtcggaataccgcgctggttgcaataaaatatctggtcttcactaatcttgcttgtcgtagcttcatgttctaccactgccgtctcattgtgaatatccatatacgggaaggtatgtgcaccacacttatctcccagcaacagagagtcacactggctataattacgggcattatccgctttctcggccacgcgtaccaacccacgataggagttctcactatgtccggcagaaatgcctttacttacaatcgtactacgagtgttcttacccagatgaatcatcttcgttccggtatctgcctgctgatagttgttcgttacagctacggaatagaattcagcggtcgagttatcgcccgtcaggatacaggaaggatatttccaggtgattgccgaaccggtttccacttgtgtccaggataatttactgtccactcctttacagttaccgcgtttagtcacaaagttgtatacaccgcccttgccttctgcatctcccggataccagttctgaacggtactgtattttacctctgcacggtcatgcacaatgatctcaacgatagcggcatgcagctgattttcatcccgcatcggagccgtacatccttccagataagaaacatacgaatcatcatccgctacaatcagcgtacgctcaaactgtcccgtgttacgggcattgatacggaaataagtggaaagctccatcgggcaacgtactcctttcggaatatacacgaaagagccgtcagagaacactgcggaattcaacgctgcaaagaaattgtcccgataacctactaccgagcccatatatttcttcaccagatccggatgctcccgcacggcttcactgaacgagcagaatataattcctttctccatcagcgtttccttgaaggtagtctttacggaaacagagtccataacggcatccactgccattccactaagagccatttgctcttccaaaggaattcccagtttattaaacgtctttatcagttcaggatcgacttcctccatgctcttcggtccttctttcttctttgtcggatcggcataataagaaatcgcctgataatcaatttcagggatacggagatgtgcccaggtaggcatttccagcgtcagccaatggcgatacgctttcagtcgaaactccagcaaccactccggttcgtcctttttcgatgaaatcagacgaatgacatcttcattaagtccacgctcaatgatgtccgtatgcacctctgtggtgaaaccgtatttatatttctcctccgcaaatttccggacaaactcattatcagtcttcttttcaagttcgtctttctgattgggtttcattttattgggttcttgttgcatctttatctttattctctaatatatattgttgcgtcatattcttcgcagcagggaaaaagatccccgcaaacgtttccatcggataatataacaaagattcttccttttttgttgcactaattaacttattatcgctgtccacaaactctatcgcaccaatcactacactcgttaacaacagaaacttaagtgctcccagcccacttcctaaccagcgattcaaccagttcaacgaaatagcctgcattgcttttgtcaatagcgaggcaatcaatacaaagatcaatggtacggcaatccagatcatgataaaagccaacacttgcgcaactgtcattgaatccgtcaccgtcgggcaaagcttttccgccaaagaagcatacagagctttcgctgccaacagaccgactattaaccccaaaatagaagccaactgacgaatgaagccttttacaaaacctacaatcgctccggcgcctattacaataaggataattatatcaatcgttgccacgtttattatgttataagctataaaccaataagtcgtatataagctgattataatgagaaggtgccgaatgataaaaaataaggtggtaaggtggtgttctgcaaacagtaccacattaccacctctttatcatatcatgacctctgctatattataacattataatacacttataaccttactatatttacagcgtctgtttcacttctatttcttcgaatgtctcaatcatatcgcctaccttcatgtcgttgcagttcaccagactgataccacactcgaagtttgtacctacttccttcacatcgtccttgaaacgtttcaatgcgttgatgtttccggtaaagatcacaataccatcgcggatcaaacgagccttgtcgctgcgtttcacctttccggtcttcaccattgctccggctacaagaccgactttcgtaatattgaatacttcgcggatttcgatggttgcagtaatctgttcctttacttccggagccaacataccttccatagcagcctttacctcttcgattgcatcgtagatgacagaatacttacggatgtcaacaccctcttggtcggccatcttaccggcagcacccgaaggacgtacctggaatccgacaataatcgcatccgaagcagcagccagagaaacatcagattcggaaattgctcccacacccttatggataacatttacctggatttgttccgtagacaacttaatcaacgagtcgctcaatgcctcaacagaaccatccacgtcacccttaacgatgatgttcaattcctggaagttacccaaagcaatacgacgacccaattcatccaatgtaaggatcttctgcgtacgcaaaccttgttcacgagccagctgctcacgtttattagtgatctcacgagcttcctgatcgctttcgactacatggaatgtgtcacctgcggcaggagcaccattcaatcccagaatcaatgccggttcggaaggtcctgcttccttgacgcgttggttacgttcgttgaacatagccttcacacgtccgtagctggttcccgccaatacgatgtctcctactttcaaagtaccgttagataccaatacagtagctacatatccgcgtcccttatccagtgaagattcgatgatggaacccgtagcattacggttcggatttgccttcaggtcgagcatttccgcttcgagcaatactttttccagcaagtcttccacacccatacctttcttggcagagatatcttgtgactgatatttaccaccccattcttcaacaaggtaattcattgcagccagttcttctttaatcttatccggatttgcagtcggtttatctaccttattgattgcaaatacaataggtacaccggcagccatcgcgtgattgatcgcttctttcgtctgtggcatcacgttatcatcggcagccacaataatgatagcaatatccgttactttggcaccacgtgcacgcatagcggtaaacgcttcgtgacccggagtatcgaggaatgtaatacgacgaccgtcttccaattgcacgttataagcaccgatatgctgggtaatacctccggcctcaccggcaattacattcgccttacggatatagtcaagcaaagaagtcttaccgtggtcaacgtgtcccatcaccgttacaatcggagcgcgcggttgcaaatcttccggagcatcttcttcttcaacgatagcttgtgccacttccgcacttacatattcagtcttgaatccgaattcttcagccaccagattgatggtttcagcatccaaacgctggttgatggaaaccatgataccaatactcatacaagtagcgataacctggttaacagaaacatccatcatcgttgccaattcgttagccgtaacgaactcggtcaacttcaataccttgctgtctgccatttcctgatcttccagttcctgcatacggttggaagccatttcacgtttctctttacggtatttggacgttttattcttacctttggttgtcagacgtgcaagggtttcttttacctgttttgctacgtcttcctcgctcacttcctgtttgataaccggtttcttgaagcgatctttattgttgttatttcttctgttgttatttccctgtccgttggcctggccaccctgaccgttactattgccgcctttaccctgtacattaggtcttggagcagcaaagttggaagttgcaacattgttaacgtccaccttctctttattgatacggttacgtttcttcttgttagcagccgcttccgcactgtccttaggtccgctcttcgccaatttagaatcatccttacggatttccttgatgatagcttccttcatcaacttcttctgatcctgacggattttttccttttcttcacgttcgcgacgtttctcttccttcgatttcttcttgggacgagtagactgattcaatgcagccaagtcgatctgaccgatcacattaatctttgcgcccaattccggttgacggattttgaaaacaccatcatcctccggagccttttccgctaccggggttacttcagcctgtgcagtttccaccttttcttcttctttatgttcttccgccttcacaggtgcagctactactaccttcggctcttcttttttcacttcttctactactttttcaacttctaccggcttcgtctccactacaggttccggcactactacgggttcaaccaccactggagtaggctctactacagaaacaggaggtgtcaccacctcttccttcttcacctcgggttctctcttctcgggctcctttttcacttcgggtttaacgacaggccgttccacaaccggttcttcctgtttctgttccggttctttctctaccttttcaggtttacgaccgttcaatttatccaaatctatttttccgacaggtttaaacttcggacgtgcatcctcaggtacgactgtcttaatcacatcttccgacttcggtttttcgggctgcttttcgaagccttcaatcgataccgacgccttattacgttccttattctgacgttcctgtatgaaacgctccgattcaagtctaaggttcttatctgtactaaactcctttacgagtatagcgtattgctcctcgctaattttagtattaggattagcctcaacggtatgccctttcttttgcaggaactcaactaccgtcgcgattcctacgttcaaatctcttgtaactttgtttaaccttatcgtcatattttaaaattaatgaataaatggagcttgtttaattgaaaattgagaattaagaaataaaagtctgctgcattatattgtatcgcaacttttaatctttaatttcatctttattttcaattgaaggatcttcttcttcaaactccgatttcaaaatgcgtattacctcgtccactgtctcttcttccaagtccgtcttttcaatcaacatctcacgaggagcattcaacacagccttcgctgtatcgatgccgatagctttgatagcgtcgatcacccatccgtcgatttcgtctctaaactcgtcgagatagatatcttcgtcagctacattctcatccaactcacggaacacgtcgatagtgtactcagttaacatactggccagtttgatattcaaaccgcctttaccgatagccagcgaaacttcttccggtttgaggaatacctctgctttcttctcttcctcgttcagacgaatagaagaaatcttagccgggcttaaagcgcgctgtataaacaatgagatgttcgatgtataattgattacgtcgatgttctcattgcgaagttcacgaacaatgccatgaatacgacttccctttacacctacacaggctcctacagggtcgattctgtcatcgtaagattccaccgcgatcttggcacgttcgccggggatacgggcaatcttcttgatggtaatcaaaccatcattaatttcgggtacttccatctcgaacaggcgttgcaggaaaacgggagaagtacgtgacaagataatcttaggattattattcttgttatccacgcgggcaactactgcacgggccgtttcacctttacgataaaagtcgctcggaatttgttcggtcttaggtaacagcaattcgtttccttcatcgtctaaaagcaacatctcttttttccagatctgatatacttctgcattgatgatagtacctaccttatctatatatttattataaatactgtctttttcgagttccagaatcttggaagccagtgtctggcgaagattcaggatcgcacgacgtccgaacttggcaaagataacctcgtcagtcacctcttcaccttcttcgtaagaagcatcaattttctgtgcttcgctcaacgaaatctgcatattcgggttagtcaaatcttcatcggccacaacttcacggttacgccatatctcgaagtcacccttgtccgggttcacgattacgtcgtaattttcatcggtgccaaacattttcgcgattacgctacggaacgactcttcgagtacgctaaccatcgtcgttctatcgatattcttcagttccttaaattccgaaaatgtatcaatcaagctgattgtttcttcttttttggccataactatttaaagctaattaagtatttagtatattttatttgctcataagtgaaggtttcgtcctcttctaccaatttcgggcgctttgatccttcggtttttactttcttttgtacgcctaccgtaaacttctcttcatcggcatctttcagtataccggccagcttccgtccgtctccggtcagcacttccacctcttgtccgatgtggatataatactgttgcagaactttaaagggttgtccgatcccagccgaccctacttccagttcataatcttcctcttcgcggttcagtttcgactctatgaagcggctaagctccacgcaatcttcaatccaaacaccttctgcatggtctatttcaaccacaatcttgtcatccgggctcacggttacctctactaaaaagtagtcttttccttccagccactcttctacaatctgacaaacagttttcttttctatcatttattagctatataagaacaaaaaaaggagcttaattgcccctccacctttcatccgttttcggttgcaaagatataaataatctgttcgactacaaaacattaaagaaaaaaagtatgaattaacagtgctatattcgtatctttacgccgtaattcaaaaaataacgactatggcacatcgtctcaacacaaataaacagtttatggtaggtaacggaattcttgcttttgccgtcatttttgtcgtggttatttttgtctatatgagcatgcggctacaacgggaaaagcaggaagaacgtcatttcatcgaaagctatacgatcagtctggtaaaaggttttgccggagattctatctcattatttgtcaacgacagtctgatctccaacaaaaccatgtcggaagaaccttacactgtagaaataggacgttttgccgaacagagcgccttgttgattgtagataataacacagaattagtgtctacgtttgatcttagtgaaaaaggaggaacttatcagttcgaaaaagaatcagacgggattaaacaattagccaagtaataaaggtattaactaagtctgtgccaccatattggcacaaccatgccatcgcattgtcacgactgtgccagcgtgttgacacaagtgtgccaacacgatagcactatcctggcaataaagtattctaaatctccgtacgatactttctcaattccccccgcaaagccaatgcttttccttctgtaaattgattgagcaatacccaaaatcgttcgctatgattcatctcgcgcgtatgacataattcgtgcagcaacacgtagtctatcaaatgagaaggtaacagaaccaggtaataggacaaattaatatcctttcgagccgagcaactgccccatctgccctgactggagtttattttcacactcgaataaggaagtccgcattgcttggacaaggaagccaaacgtgaaggaaggatacttttcgcattccgcctcaacgattcttcaatcaccttatgcaaccagctttgcagtttctcgtccgtaaaatccgcatgaggcggacaaacaatttccataacccccaaccgggaattagccagaaactgatccttttcaccggacaccaaggacaacttaaagtgttccgcatcaattttatagtccaaatcaatcaatggccgggctaatttttgacgggaggccagaagtttaccacgcagattctcgattgcctgcttcacttctttcaatgtagtgccgggaggaactgaaacataaacagcatcactctttgtacgaaacacaagactcctcgcacgtgaattgacacgcactatcagacgtcctaattcgtcatcttctacgatcttatccattataatcctcctatcaacagccacaaaagtaataaaaaagaagattccaatgaaaaacttcgcggaagatgcaactttatatcagtttcttccgtctaactgtcatatcaatcatagaaaaacataattatgaaaacaagtttattgctcgtattagtcaccggattgtctctagtacttactgccggctcttgcttgcagggaaaacacgtagtaggcagcaaaaactacatctcccaagaagtaaaagccgatcatttcaatgaaatcaaactattgggaagtgccaatatcagttatcaccaagacacacgcagtcacgtggagatacatggttccgacaacattataccacttgtagaaacgtatgtagacggtaatacattaatgataaaattcaagaagaatgtcagtatatggaaaggaaaactggaaataaaagtttttgctccggaactgaataagctgtcaatcaacggatcgggaaatataaaattaatcaatggaatacaaacctctaaagatatcgagttccatataaatggttcggggaacattcagggagaagggcttaattgccgaagaatggctgtttcaattaacggatcgggagatgttagactgcaacaaatagagagccaggaatgtcaggcaggaatttcaggttcgggtaatattaatcttaaaggtaaagccattcaagcaaaatatgctattgccggatcgggaaacattcaggctgcagatttagaagcagagaatacggatgcaagtatcagtggatccggaaacatcagttgttatgcaagtcaaaaactggttgcccgcgtgaaaggaagtggcgatattgcctataaaggcaatccacaagaagtggatgctccacggaaaaacatacggcagatcaaataaagacaatttgaacaaatacagtctaaaagcataaaagggctactgcatcgcgcggtagcccatttatttagttagttttattataaaaatttgagagaattgaaaacttcacagtttcgccttcgttgttgttttaattaagcacactaactatattatatgtttaaagcaaatgaaaatgtctattcgtttataacttgcaccttgtggttaaccctcgccaaactatcggctagaacctgttccgctttcacatcatttgaaatagcgaccgatggtgctgttacttgtttaccaatggtatccgttgccaatacacttccgtcatctccggagaaagaatgttgtgccacattccccaaagaaaggatgattgcaatcacggcagcggctttgaacagaggaataaaacgaccggtcagtgtcaagcgtttcgcttttacgaccgtaggctccacctctgccagaatacgtgtatcaaagtcttcgcccagtcctacttcctgctgaacctgttgataaacaaacaggtttttatagcgaagcaaatgagcaggaacttcctcctttgcgaagaagtcgcgcaatgttgcttcctcctcaacggaagtttcgcattgccagtatcgctccaggagctgttctatatccttataatccatattcgtcaatttctaaatacctttgttttactttttgtctggctctgaagaggttcactttaacttgttcctctgtcagattcagcaaccctgcaattttcttatagctttcaccttcaatgtccctcagttgcatgataagccgctgtttttcgggaagttcgtttaccagtctattaataatgttcattctttcatcatgaatcatctggtcatacggactgtttgcatcaggttcttcctccatctcgggggtgagttccacgttttgagcttctttcttttgacttctatctatcgccagattctttgccactgtcaggcaataggcttcgaccgattcaaattgagaccactcatcacgcttattccacactcttatcatggtgtcctgaacgacatcctcggcttcggccctatccagggtgattctgagagccaatcgaaagagtttatccttcaacggcaaaatatcgtttcggaagctgatttcttgcatctctataataatgacgggctaggatatgaaaagttacagtcgcccactacttttttttgaattatttttttattcttgttccaccagagttattaatcgctgatgctaaggtgattaccacttcagatactcctgcatttattgcttcaaaagaattctccaacttgggaatcatacctccctgaataacgccatcagctacatattgttcaaattcggcacgggtgatttggggaatcacactgtcgtcatcattctcgtcacgcaacacgcctttcttctcaaaacaatataccaatgtcacatcaaacagggccgacaacgctttcgccgtttctccggcaatggtatctgcattcgtattcagcatattgccgtggccgtcgtgcgtcaatggagccatcacaggaacaacgcctttatgtatcaaatccgacaataaagtagcgtccacctgttccacatctcccacaaacccgtagtctacttctttcaccggacgtttcaccgaacggattacattcatatccgcaccggtcaatccgagtgcattgactccgcgtgcttgcagacctgccacaatatttttattcaccaatccgccatacaccatcgttacgactttcaatgtttcggcatcggtaatccgacgaccatttaccatcttgctttcaatacccagttgtgcggcaatctttgttgccgaacgaccgccaccatgaaccaacactttatgtccgtcgatagcggcaaagtcatttaacaactgacgaagggtggcttcctcttctacgattttgccacccaccttaataactgttagtttttctctcatttcttgatttctaataagttcaccgaatggagaatccggctccggcaccctgccggttattccaaataagtatatccgtaaagccccgaacgatagttggaaaggaattcttttccttcttccaaagaaatctttccttctttcactgatttcgtcacccaagtttcgagcgtacgtaccagtttcttcggattgtactgcacatagtccaacacctccgctaccgtttctccgtcgataatctgttcgatattatatcctttctcgttcaccgaaacatgcacggcattcgtatcaccaaacaaattatgcatatctcccaaaatctcctgataagctcccaccaggaacacagccacataataaggttctgttttcttcagtgcatgtacaggcagataatgagccacgttacgggtagagataaagttggcaattttgccgtccgagtcgcaggttatatcttgcaaggtagccgaacgttccggtttctcatccaatcgctggataggcatgatcgggaatatctggtcaatcgcccaagagtcgggaagcgactggaagagcgagaaattacagaaatatttatcggcaagcaacttagacagtccgcggaattcatcaggcgcatgcttcaaaccgccggcaatctgattaatctcacgtgtaatagaccaatacagacgctcgatttgtgcacgggttttcagatctacgattccatgactgaacaagtccagcgcttcctctctgatctgctgcgcatcgtgccatgcttccaacatcttattctgattcagcgaatcccagattccatataactcctgcaccaattcgtgtgcatccggagcaatttcctcctcgtcatcccattcgggcaatgtagcggtttcaagtacctcaaagataagaacagaatgatgtgccgtcaatgcgcgtccactctccgttatgatattcgggtgtgggataccatttttatcgctcacgtccaccaaagtagaaatagagtcgtttacatattcctggatggaataattcacgctgccttcgctattggacgaacgggttccgtcataatccactccgagtccaccgccaatatctacaaactccacattgaatcccatcgaatgtagctgcacgtagaactgtgaagcctcacgcaaagccgttttaatacgacgtatctttgtcacctgactaccgatatggaaatgaatcagtttcaaacaatccttcatccctttgctctccaggaagtcgagcgcttcgagaagttcactggaagtcaagccgaatttgctggcatcacctccagactcttcccactttccgctaccggaagaagcgagtttgatacgtataccgatgttaggctgcacattcagctgttttgccatctttgcaatcagcttcagttcgttcatcttctctacaacgaggaagatacgtttacccattttctgggcaagcaaagccagttcgatgtaactttcgtctttatatccgttacagacaatcaatgagtcagaatccgtattgaccgcaatcactgcatggagttccggtttggaaccggcttccagtccgagattgaacttctttccgtggctgataatctcttccaccaccgggcgcatttggttgaccttaatcggataaattataaagttctcggctttataaccatactcttcggccgcttgtttaaagcaggaagacatcttttcaatacggttgtccaaaatatccggaaaacgtatcaacatgggagaagccacatcacgcaattgcaactcatcgaccagttctttcagatcgacagtcactccgtctctacgaggtgtaacaactacatgacctttgtcattaataccaaagtacgaggtaccccaacctgtgatgttgtagagttcctcagaatcttcaatacgccactttctcattttctgttattcagtgtttttagtaaataattggacggcaaaaatacggattaatctacatgttggcaattaattagacattaaatctttcaaacggtccatataaccactatttccgttacgggcgtcatagcgacgtgccagctcttctgcctgttgatagaaataattgcgaagttcgtttacctgataaatcccatccggacgataaagcgggaactcttccggcaaagacaacgagacttccggacgggtttcatatttcagagcctctaccatatcacaggagaaacgataactcttcagcgtattagtacgcaaactccaaccgatacagcgttcggcatattcccaagctctttccggcttcgtcatcatattataggcaataaacaatcccagatagagcaaaagatattcatccttctctcttcccaccaatgcttcttcggcacgtgcacacatatcggcggcaatctccggtttacctgctttctgcgcataataagcaagcttcaaataggcccgcaaattggcttcataacaagtgacctgcttattaatcaacggttgcgcgcggctgtaagcctcatcaaactgtcccgtttccagataataatccagcataaagttcaattcacaagcctcacacgactgatcgtctatcttctcattcaacattttatcaatgtattctttcgccttgtcatactgccgcatccagacacattccacagaccagcggtgataataactccgcaaagaatacccgttccggaggatacgggttttataatcctccccaattgcctgtacctgctccatcgggatctccggaagatcgaacgtacaagcccatatccacttatatttccacaacaagtcatcttccttaatcacatccttgtggttctcgtaatcatccagaattttagagaacacggtaatctcttcagcatccgccgaaagaagattcagttcataaataagatccagtctcaactccgtagcccattccacatcttcgttctcatcggcgatgcggatagcttctttcaatagattggctttttcgcggggatgcaggttgtcattctgtgtctgcaacagcaatttttgtatttcaagtgtgtatctcatactcttttttaattcaggaaatttataaaatcattcattttcgaagtcatcagttcacttagcgaatggttgaaaagctccatttcttcgctgtttaccggatatttaccttgcagaagcgattgtacatacaatatatgcaccacatgctgaaacagtttattgtctccttgtatttgcaataaggtctgcaccatttcattatccgcattgaaagtgagtgtcggcggaatctgctttgtagtattcacagctcccagtacagccgccaacggattattagcacttttagcggcattctccttttcctccgccacaaaaataaccggaatatccaccggagtaaaatgcttcagacgacagatacagccaaatcgcttcaacaactcgttcgctttcacctcaaaagcctgaaactcctggttcgcctccacttcaccaaactgctccagcaaccgtgaaggagatatttcatccaaagtaagttccggattcaggcggacatactttttcaacaacgtttcatcaaacgtataagcagcattcacgaccagccaaccctgtgctccggctatacgccgcacttgccggaaatcctccagattcttggtataacatatcacattgcttgccgaacgaatacttccaaagctacgcaaacccttattggtttcaaaaggaagataatccataaacaaacgaagcaattcattatcctccgaagcaatcgccttgatatgaaagtgatgaacatccagaatccgattgaacatggcacggtcattctgcaccaatccccgcagataatccttgatagccaccccgatctctttccgggcatctttcagttggtcattactcaccaaagactcccgggaagcggtagacagcaacccgtccgcattcaccagacaacggataaagaaagcccacgacggcaacagattgcaatcatcctcactcaacagcatacgtttgagatagaccttatgagagttgcgcactgaaaattgtgtacggaaaggcaggacataaagcaccccttccaccttgccgctttcagtatagatccggaaagcatcgagagcagacgattgaaacactttcgctccataatccagcaactccttacgagtcgccttcgggtcaagccatacaggcgaaggcgtatttaccaactcctcttccccctgataatgcagatagataggatacggcagcacttctccgtaaccgaccagtatcttcttaaatgtttcatattcaaaaagatgcatccagtctcctttcgggtgcaataccacttgtgagccgatgggccgttcttcgtctgataaagtcagctgatacgtcccatccacttttccacaccagcaaacaggctgtccgcccattgcagaacgactctctacggtgatttcattggtcaccacaaaacaagataacaatccgataccgaaccttccgataaaatcgtccgcatcgggagtatcccgctttgagctctccccgataacagtcagaaagcgataaacttcctcctctttcagtccgataccattatcccgaaataccactgtcttgtcctcattcagaaagacatcgatgcgacctttataattctcgtcaatattgcgtagagccgtgatggcatctacgcaattctgcaacagttcgcgaacaaaagtattcgggttactataaatgtgctctgataacagggcaatcatacctttaagattgacctgaaacagattattcccttctttttccatgttcctcttttacttcctcctccttccggtgattttaagagctttctcattgccattctctgcggccttttcgaaccactccattgcaatttcatcgttttcttccacgccatttcctgtcagataggcatttccaagttcaaattgtgctttatcgttatttttctcggcagctttcagcaaccattgcactgcagcttccggatcagggttacaaccttcgccatacatcatcatcttgcccagataataaattgcagcgacattctcattccccgccgcatccgtgaaccagcgataggcctcagcataattctgtttcacacctactccgttataatagcaaagtccggtacgatacatacttgtcgtatttccattatccgcagccagtgtataatatttaaaggcttccgtttcattctcttccactccgatacccatttcataacagatacccagtccttcactataccattcatattcggcagctttcttgaaataagcaaaagccttttccgactcattcaggctatcatagtcatacagataatactcacccacacgcagcatagccatcggaatctcattagccactgccttttcataccattccactgccgttttattatcttccagacagggaccgcaaccgaagaaataataatctcccatcttaaactgagcatagccataatcctgttcagcagccttcatcatatattccactgccttctgtggattctcttccacgccattaccattctcataagccatccccagttccgtcagacaacgggcttcattcttttccgcccctttactaaaccattcgagtgccctatcccaattttcttccgttccgataccttctctatagcaacgtcccaaagcaaagatcgcatcattatcgtccgcttcagctgcctttgtataccaggcaaaggcctcttccggtttcacttcaccaagaacacccttttccatataaagacctacacggaacattgcataaggataaccctgttcggcagccttgctaatcagttcaaatgacttttcataattcttctccactccatcgccattctcatataagaatgccagttccacaagggcaaagcaagcacccagttcggccgctttttcataatattcccttgattttacagggtccttcacaccgctatatccattagccagataaagagccacacggcaatacccatcggcattattcagtgaagccgctttttcataaaactctaaagccttcacataatccggttcttcagacaagaagccacgttcatacatccagcccaaacgataagctgcacttcccgaacccaactcaatggctttctccaacaactctttcgcgcgattcatgtcttccggcaccaaatcaccgttgaaataaatattggccagtccttcgataccttgtatataatcatcctccacgcaacggttcagacacatcagtccacgttccacgttcttatattcatcattatacaggtagatcaatgccagttcatacgcactgtagggttcacaataaagcatgcccttttccagccattcaatcgccttaggcatatccagccattcctcctcctgatagttatatcccaggaaattggcggcagaccacacaccggcatgccaagccttttcccaaagttcaaagctcaattctttcggtttattcagttccgggtaacggaaataaagcgtagccagatttttaagactataaagattgggaactatttccagggctttttcgtagtaagcagcttcctctgccacgttaccttccgctctgtcgagcgcatctcctaacgatgcatatacatgagcacgcaaacgttcaccttcaggcagttcggcaagcagttcattccgtatctgtaatgcctttgctttatcccctgcaaattcttcggcaaaagcacgataatgctttccccataaaatagcttcgggagaagtgagagctgcaaaacgccgttcaccctcttctttatcttgttcgcaatagaatcccatgtatcgccaataggcaacagttgcttccgcttcagcccaacccatatcggcggccttctcgtagtatggaaacaaataactcatgtcccgctttccataacgggcttcggaatattgtgcacccttctgcgcccatcccgcaccgctaaactctgccacacggtcgcatacctgcatcaccttttcccaccagaattcatattcttccgcgttgagttccacctctacgttacagtcaaaagcactgaatatcagttcaaaaaaatcttctgttaatttctcgtcttcttttgtgtccaaagcatattcacatacagccaatgcttcccaccagttttccgcacttaacaatgaagccggtgtatactgcggaaaccatacccttgcaggctgtccggatgctttaattttagcggataactccccaaatttctcttttaaagttttcatgatatagaactttaccttaattttgtgttactagtcaataaaaaatctcataacgagtgcaaggtacaaatattgaccgaatgcacaaacaagagtctcaaaaaaaacgaagttccaacaaaaagagaacattacaactacctgatttctgaatacagtaaaattcctcccaataatcattcattatcaggcacaaattacacacattccacagctttccaaatgacgattacacaaaatataacgactgttacttctacaatcccaaaagttgtcgcaaacattgcaccgatgtttcaatctgccaacgatcttccaattcgtctgcattaaagatatattgtgcctgatgataaaaaggagcacgcttctcgagtgcctgaacaatgaacgctttcagttcttcatcctctttaccctgaagaataggacgttgttgtttagccacacgcaagcgcctgaacaacacatccggatgcacctccagaaaaacagtctttccggtccggttcataaaatccatattatcataaaaacaaggcgctccaccccccgtcgaaattaccacattctcaaactcagctacttcatggagcatatttctctccagctccctgaatcctgtttcgcctcgttcaatgaataattctccaacggttttgtgaaaacgctcttcaatataccagtccagatcgatgaacggtatattcatatatcgggcaaaagccttacccaacgtcgtttttccagcacccatatagccggtaaggaagatacgaaccataaatgattaattttgctcacaaaattaatcatttaatgaagaatgaagaatgaagaataaagaattttagccattatgccatccaattcttcattattcattcttcattcccgatttatttaaagattctcacccgttcttcaagcggctggaattctttttcacccggtttgccgagaggaagtccgaacggcatttccgcaatcaaatgccaatgttccggcaaatcccatgcacggcgcacttcttcatcaatcaacgggttatagtgttgcagcgatgctccgaaacctacatcttcgagcattacccagatagctaactggtgcatggcagaagtctgcaatgaccatcccgggaaattctcctgataagccgggaaagcctcctgaagccctttcacaaccttctgatcctcaaaaaacaatacagtgccatacccacaggcaaacgaatgatctatcttctcctctgtcttgacaaacgcttcagccggtacaatcttctttaatgcgtccttcacaatctgccacaatttcttatgcgattctcccaatagaagtaccacacgggtagattgcgaattgaatgccgacggtacgtggcgcacggtcatattaacgatacattcgatctcctgatcggatataggtgactgattagtaattgaatagtaagttcgacgttgtttcaaagcttcactaaaagatctttccataatagttcctttcttattttatattcttaaaactctcttttttttataacaagtagcccccctaacttgttcagttagagaatatatttgtaccttcgcagcgtcaattcattgactatctaaaattatcgtcagaaaaaatggctaaacagaaattttatgtagtatgggaaggtgtcacccccggagtttatacttcctggacagactgccaacttcaaatcaaaggatatgaagctgccaaatacaaatcatttgatacgcgcgaagaagcggaacgcgcgttgacaatgtctccctatgcttatatcggcaagaatgcaaaggctaaatcaggaggtcctaaaccttcttcagatactttaccttcttgtgtgatcgacaatagcctggctgtcgatgcagcctgtagcggtaatccgggaccgatggaatatcgcggcgtacacattgccagccgtcaggagatttttcatttcggcccgatgaaaggcacgaataatatcggtgagtttctagccatcgtacacggtttggcgttgctgaaaaagaaaggtttcgatatgcccatttacagtgacagcgcgaatgccatcagctgggtgcgacagaaaaagtgcaagaccaaactcccccgaaccccggaaacagaagaactctttctgttgattgaacgggcagaaaaatggttgcagggaaacacctataccacccgtattctgaaatgggaaacgaaagaatggggagaaattccggccgacttcggcagaaaataaaagaacataaatttcaatataagataaagatgaaaacattgacttcaaacaaagctttctggctgttactagtcatttgcgtagttactatcctgcctttcctcggtttatcggagtaccacaccaaaggggagcctcgcgaatctattgtctcctactccatgctggatagcggaaactggattttacccagaaacaacggaggagaaatggcttacaaaccgcctttcttccactggagcattgctgctgtttcggcagcagtgaatggagggcaagtcacagaaatgacctcccgcttgccgtctgccatcgccctgatcgccatgaccctctgcggctttctgttctttgccaaaagaaaaggagtggaactggcgttgttggccgcctttattaccctgactaattttgagctgcaccgggccggagcaaactgccgggtggatatggtattgacagcgctcaccgttggcgctctgtattgtctctacaaatggtatgagaagggactcaaaggtattccctggctggccattctcctgatgagttgcggaacactgactaaaggaccggtaggtactatcattccatgtttagtggtaggcatcttcttgttactccggggtgtcaacttcttcaaagcattcttgttactttccgcctgggccattctttcactcatcctgcctttctgctggtatgtcgctgcttaccaacaaggtggagaagagttcctggcattagttatggaagaaaacttcggtcgtatgactaataccatgagttacaattcatgcgtgaacccctggcattataattttgtgaccctatttgccggatacgttccctggacactgttagtcgtgctctccctgttcagcctgacttaccataaattcagcatccaaccggcagcctggtggaaacgcttcaccacatggataaagaatatggacccggtggatttattctctttcaccagtatcgttgtaatcttcgtcttctactgtattccgcagagcaaacgtagtgtatatctgatgccgatctatcctttcattgcttatttccttgccaaatatctattctatctggtcaagaagcaatctaaagtcatcaaggtatacggaagtattcttgcagtaatcagcctgctactgttcacctgcttcatcgtattaaaatgcggactcatccctgaaactattttccagggtcgtcacgcgcaggacaatattaatttcatgcgtgcaatacagaatatcagcggagcaggggccttattcctgattgccattcctaccattctcggtatctactggtggttctatcaacggaaaaatgcattgaacaaccgtttcctatacgctctcgttgtgcttacaatgggattataccttgcattggacggtgcttatcagccggcagcattaaattcgaagtcggtcaaattcatcgctacagaaatagaaaaggttgcgccggaaagcgaaggaacgatgtacgaattcattgaagaaagtctgcatgcagcaggtgaccccgtacattatttcgaactcaatttctatctgcacaatcgtctcgacaacttctatgagaaacgtccttcggaaggtttcttgttaatcggcacgaatgatgcagagaaatatcttcccgaattcgagaaagaagggtatcagtttgaggaggtatatgaatcccctaaacgagtactccggcaaatagccaagatatacaagttcgttaaaaaccaacagcctgaaaataacgaaacgactcctattgttgagtaaaaggtatagaattaagcgtttttccatgcttcacaaggaactccgccgattggagcatggaaaaactatattctttcaaaggaaaaaagctatcatccatcggaacagcattcaatttgccgttaccgatatcataagtaagttcctgctgagtctcgtaattataaaggtagagtaacgtgtcattgcgtcccaccaccatattgtcagcagtatagaacatacagggacgttcttccttcagcaagtccactccaaaattattctgtagataatcaatattcaacagccctaatattgttggctgtatatctacctgaccgccaaatgcagttttctcttccggctgaatacggctggagtaaatcatcagtggaatatgattataagattccggtagttcacattcggcgtctcccaccagtttgccatgatctccttccaatacgaatatcgtattatcaaaccagggttgtttacgcgcctcttcaaagaactgacgcaaagcccaatccgcatactcaacgatctgcatctccggttcacttgttttcggatggaagaaaggaggtatcacatacggcggatgattactgatggacagtaaagtagcaaaaaacggttgtccggtggcagcccgctgattcaataccggaattgcatagtcatacaagaaatcatcctgcactccaaagctattcacaaccttatcaaccggatagtcttcttgtgaaaacacttcatcatagccgttcgtccggaagaaagcgttcatattatcatactgtccttcatgcgtcataaagaaaaggttgtaatagccgttttctttcagtacggtaggcagtcccgaatagcggggaatgacagagcctttcatcaggttccgtttcatcatagccggaaaagaatacaaggtggcatacaaaccatggttcgtatggattcctgccgaatagaaattgcggaaactgatagaacgggtatacaggctatccaggaaaggagtcaaagtctccgattgcccgaaatgcttcataaacttggcggacatagactccatcataatcaagacgacattaggacggcgttgttgcacgctatccgcttttgcagcatgcctataaacagccaacggggaaacattcgcatctcccggacggttgagcagagcttgcgccttggtgatggcttcctgttcatccatcagatgcaagtatttattttcaggtctcatatcatccatcacactcgtcagcaggttaaaagtaggacttactcccagttgattgagaaaagcatcctgacagaaatatgccgcacttactttgatcgggttatagcctgtacgcccccggattccaaagatgcagagtccgattaagcaagcaccgatcagaaccgcccctcctcgcttccaataaggaaacggagcggaaatggtaaggctacgatgatggaaataacgtgccagatagataagccaaactacgaatccggccagaaagagaaggaataatccgatggacagataataggcactttcccccaatatcattccggcggtagttcccgcataaccgaaccattcgaatatggaagagttgatatgtttaaagaaataggcaaaataaggaatgtccgacgcactgattaaataaaccaatccataaaagacactgaaaaagatcgtaaagaaacggaacaacgctttcccataatagttgcaaactccacataccaccgcaactaccagaggcaacagaagtatgtaacagcctatcacattgtcaaaccagacaccatgcacaaaagcaagcatcggaagtgtcttatccgacaaggcttcagaggtcaactgatgataagatgagataaaaagtaccaggcgaaacagtcctgcgatcagtaaagccgaaacatgtatggtaagtatatatacaataagatttagaaaacgtttcataatagccttttctttttatgaattaaatgaaagggattgaatagtgttatttcctccctttatagatataaacgaaatgaagaatcaggaaattgataggcaccacgataatcattaccagtatcggtgcaagcagttcacccgcccctatccagaggaagagattcagtaagccgatctcaagcaggtaattaatcagatgactaaaaccaaagccgatcgcattatgcgaggatggtttggaacgaaaggtgaagaaagtagtcaggaagtagttgcagacaaatcctacagcataaccagccgtaaaggagatattggcattcgcaaccaacaagaccaggcaatatacgccgtaatgaatggctgaagatatagtgccgacaactccaaaacgaacaaattgccagaacttatcccgccaatccgggtgcttctcaagtatagccttacttattctgatcatcgtacaacacttcttccacattatagagcggacgacgttttacctctttataaatcttgccaatatacagtccgacagctcctatggataataaaacaaccccgccaacaaaccagatagacaacatcaaagaggcccagccatgttccgcagtacccgaaatcaatgcgtaaagaacatagattccaatcaaaatactgataaaaacaaagatacctcccagataaacaattccgtaaatgggctttaccgagaaagaggttatcccgtccaaagccagactgaacatctttctcactgtatatttggaagttccggctgtccgttcccggatcacatcatctaccgtagtagaagggaaacccagcaacgggataataccacgcagatagacattgcgttcctgataatgagacaacttttccagcactctccggcttagaaaacgaaaatccgcatgattgtagatagtctccactcccatcctgtgctgtaatttataaaaggctgttgcagaaagacgtttcaacacggggtctgcctgacgggatactttcactccatatacaacatcatatccttgcatataggcatcgaccatctcctcaatcgcattcagatcatcctgcaaatcggcatcaatggtaataacggcatcactccagtctttagcggtcatcataccggccatgatcgcatactgatgtcccacgttccgtgccagattcattccttttatataaggattcgtcccgtgcagtttcttaatgatgctccatgtacgatctttgctgccatcattcacaaagagcacaaagctgtcggcactgatcttttctttcgccaccaactcatcaaacaaggctgtcaaacgggcggccgaatcttccaacacttcctcctcattatagcagggggatacaatagccaattttatcatttttcgtccggtttatttagttcagccagttttatctgtgcaaattccgagtaagtcataaaagcatatcctttttctttcagtttgcggataagcacatccaaacgttcctccattcctttaccggaatgattgcggataataaaaggcatcttaaattcaggatgttcacccaacgggtagaattcccacgggtggaaataagtcacaaaatatccgtcatgcttcaatacccggtttaccaggagttgatacagccacatcggcagattatgacaagacaaccagaatagcgggaagcgaatccacggagttacagaagccgggatttgaagtaacttacccgtcataaagcaggtacggggctccgacaaatgcatatatcttccggggataaatgcgggattcaatgaggagttatatacataccccatccgttcaagttccgtatctgatacggggaacatacgcggctggcgataaccttgtatcgtcctgccggtaagacgttccagaatttcttttgaacgactgacatccgaagcctgtggctgccaatggtcacatccatgcgcagcaacttcatgtccttcgtccataatgcgccgcatcacttccggcgcattttctgcaaaattgcttgtacaaaagaaagtagctttcaccccgttgtttttcaggcagtccagtatccgatttgtaccatagactgacactttcattgcttcatccaacggaaagtctacaccatgctcacgaggtacatcaaattcttctgtatcaaaacttaataatatcattgcaatatcaagaattacaactgctgcatatcatgcagacgtttatagtaaccgtttaactctatgagttcttcatgcttaccacgttccacaatctcaccctcatacagtacacagatttcatctgcattcttaatcgtagaaagacggtgggcaatagcaatcgtcgtacgtgttttcatcaaacgttccaacgcttcctgtacaagacgttctgattcggtatccaaagcagaagtagcctcatcaagaatcagaatcggaggattcttcaaaatagcacgcgcaatactgatacgctgacgctgaccaccggacaattttccgccacggtcaccgatattcatattatatccttccggtttctccataatgaaatcatgcgcattggcaatcttcgccgcctctactacttgttccattgtcgcattctccacaccaaaagcaatgttattgaagaatgtatcattaaacagaatagcctcctggtttacattaccaatcaaactgcgcaaatctgcaatacgtacatcacgaatacttgttccgtcaatggtaatatcaccttcctgcacatcgtggtaacgcggcaacaaatcgactaatgtagatttaccggatcccgattggccaaccagtgcgattgtttttcctttgggaactgtcaggtttacatgcttcaacacctctcttttaccatcatagctgaaagagatatctttaaattcgattctatcattcaaacctttcaacggtttcggattcggaatttccttaatcttattctctgccttcaggattttgtccacacgttccatggaagccaaccctttcggaatgttgtatcccgctttagcaaagtctttcaatggattgattacactatataagataaccatatagaagatgaatgtaggagcatcgatggttgcattctttcctaaaatcaatgtacctccaaaccacaatacagctacaatcagaatcgttcctaagaactcactcatcggatgagccatagcctgacgtatagcaaccttgtttgtcgcatcccggagctcgttgctacatttggtgaagcggttaatcattttatcttccgcaataaaagccttgatgatgcgcaagcctcccagtgtttcttctaattgtgacatcgtatcactccacttagcctgtgcttccagtgattgacgtttcagttttcttccgacgactcccatcaaccaacccattcccggtaatacaatgatagtaaaaagagtcaactgccaactaaccgtaaccaatgtcacaaaatatataataatcagaatcgggcttttcatcaacatatccaatgaactggtaatggaattttccacttcccccacatcaccactcatacgagctataatatctccctttctttcttccgagaagaaagacatcggcagacgcattaccttagcatacaccataatacgaatatcacgtaccactcctgtacgtaatggaatcatcacggctgaagaagcaaagtaacaaccggttttaaacaatgtcatcaccatcaggaatagtcccaagaaaataagagctacagtgggaccattatccacaatcatctgagagatgtaataatagaagttattcttggcaacatctgctaaatcgccactaccccattccataaaatggtacaccttatctgctccttctgttttaaacagaatactcaagataggaatcaaaaaagtaaatgagaacacattgaatacagcagacaaaatattcagcaaaatagcccagccgatatacttcttataaggcgacacaaaacgtcgcattagttgtagaaattccttcattatttaccattaaaaaagttaagaccgcaaagatacaataaaacagattaacaggcagcagtttctattaattattaacgcgatttatcgaaaagccctcttcaataaatgaaatatgacttaataattctctttcagccaaatacccaagaaacgatcatatatttgacaaatacccatttcctgagtcacaaaatccttttccagcaacccttttagtgctgcctgaactgaactagcagaagccagtttgtattttttaataaaagtgccggaagtgagagctttagcccttccttctttagtgatagcaattagcagttccttttgtttctccggcaaacgaaaaagaatttccgaataagtatatctgaatgaatcaataatctgccgaatagcccctgacaccattcccactttacaaactccgtactccggggtcatatcataaagtgtattcaatactttttgtatataccatgtgattccttcaaactgttgataaactgtggtaacagcactttcctctatttctttgcctgcacgtttgaaatgcatacttgcaaaacgaatatattcttctaaaggaatactttccaaatgcatcattgacacactttgataaaaaggtctggaaggcgtcaaaaacatattccccatcacatgtcgctggctcccggcaaaaatgaaacgcgcattattacaatgctgcacataagtccggagagtagcctctacatttttctccacatatccagtaatctgctgaaattcatcaatagcaatcaaacaaggcttatccgcttgctctaaataccggaagatttcatcaagcgtagtagccggagcttgtatatctcctaatcccagattcaaagaaggcataccattcacatcaaaagagatactagcctgcaaagattttacacattcccaaaagccatgcaaagctttcttccccataggtttcagtacttccaaaatctccttactaagtgcaaagaccaaatcacgcaatgaacggctatcatatatatcaataaaaaaggtatagtaaccctgtttaatttcaggaaactgaaagcaatgacggatcagccctgtttttcccattcgccgggtagagacaagagccaaattattcccattcatcacctcgcgcaccaactgttcgctctcaaaacggcgatcgcaaaaataatcagcagagacatatccgcttgttataaaaggatttcttatcatagtcttcatacatctcacgttattacgcaaagataattattataaaataataaaagccatctactatacattatttcatcatcatccctactcaacaggcaccacatgataataaaccccacgcgttttcctgaacgactttacacccaatctctgcaagagacgtccgaaataattaacttgcccggaagaaaacttcattttacttgctttttgtatccgttgaaggatatccgcagcaagtaaccattctccctcttcttcctcttccgctgcccggtaatatacctgaaacaattgttcaatcaccggcgactgttcaaactcccggttagcctccgtcataatcgcctcctctttttcatcaaaccaatagcgctcattactccgcaatgcagccattgcctgtgcatataactgctcataatcaatagggcggaccacatctatcactcccgtcacctcgacaccgataaaacggcgactgccggaagtatccgtcaacagatccttatgattacttgtgcctataaaagaagcgtaccggcggagttcctccactgccgaagcattcggacgtcgcgtattgacaacaggcttttgcagaatatgcttgagaaaagactgctgactgatgccaatctgatcgaactcatccatattaatcaataaaaagcgattcaaatacagttcagcatcccgtttccgactgaaatcgatactgtccgtataatatgcctgtaaacatggtggtaagatcaagcggcaaaatgtagacttacgataagcttgcgggcctatcaatataggcgaagtgctattcgcatgattcttacccatcccacgccaatgtgcgaccatactaagaaaccaacgacgaaacaattgagtccaataaggatggtcacaaggaacccgtttggctaaattgccaatataatccttaccgttccaacgaggaaggtcataaagaaactcttcaataggttgataaaccggtacatgatccgaattcaggaaacgcacgacatctttatcccaaagtttaagcccctcatattgtgcattcattgtaatgcttgccatcaaccgtttatccaccggaagaaaataaaaattaaagctattccgttcgcgacattccacttgtgacgttagttggttgaaacggaaatcataacgccgtttcataaactcatccatctgcatgacaaataattgttccggcaacaggctgctcttactcgcaaatccctctgaagtccgatatacattccgtacagtcccccgaaccaatgtatcatcttttggcaaacgataatgcgcccgacaccatcgcaccgtatcttcttcaggaataccggcgcgaaaacaatacccggccagatttatcaacaaagactgtttatcaccttcttccggttgataaccatcctcctcatccagtgcacgtgcgaaggctgcttcaaaaagaacagaaagcgcatcacatctttcataccccggtgcaagccgttgcaatggtgaagtttccgtttgcacccgttcacgataagtggtttcgcccggcatagccacaggttgtttcatataaataggcatcgcttcgggattaaaatacaaatccggatcaaaagtccagcgacaatattgttccaatgaaggttctttcagttcgatatcaaaaggaagttggggctgatagaatttcacagccaaccgataggcgtgtgcatgaaaaagctctgcctgttcacgggtttccggtaaaaggtcattgggataagtaaaacggacccatatcttcactgactttccggaagaaccggtgaaagctaaataagtttgcggcagctccctcacccgctctttcacttcatccgcttccatattcccggataagttattcacctgaatcatcacaattccgttgtattcactcatggtcgttattccgtctttgcggaaaaaggccgctgcaggtatcaccttctgcactttctgcacatagtcatttttatcacccggaagcataaaaggcaggacttctctcatttttgaaacagactgtgctttggtttccactttcatttgctctacgagctgttcgattcttaacgtacgcatagtgttcaccttgccatcgtctcttaccaatgttattctcattgcttaattaatttatttgtcctgcatgtgtttgtagggcgattattaccacagacaaatgtacggttaatatcccgtataaacaaatttgacacctcccaaacgcacgtccactagtaatgatttgcaattcttattctcatattctcataagtttcagataaaacacacaaaatcagcatagtacaccatgagaaacgtttttaaatccggtatttctcatactttgtctttcatttttactcaaaaattgtctatttatcatagtattccggatcatttctcatagtcaaataccaaccattcatttcgctcattggccaaccttattttacacagccctcatctattatttacatgtaaacaaccgtgtaattatttgtttttcagttaataatgtcgtatctttgaaagaggatctcaatcgtttcactacagtgaacggttctgttcactagagtagaaagatctgtctactagagtgaaaagaaccgttcactctagtggaacgaactagctggtagttaaataataaaagaataaaggcaagatacactaagcgcatcaattacataatatataaacaaccattaaattagaacaaagatggcaatacaattcgagttttataagaatccccaaccggagaaagaaggagaagaacctagttatcatccacgggtagtcaactttcaacatgtgactactcaaaaattggcaagagaaatccacatggcaaccactttcggaaaagcggaagtagaagccatgctaatggaattgagcagatgcatgggcaaccacctatgcgaaggagaacgagtacatctggatgggatcggctatttccagattacattgcaagcgaccgaacccgtgcactcgcttaccacccgtgcagataaagtgaaactaaaatccattaacttccaggctgacaggaatttaaagagtttgtgtatgagtagtcacttacgacgttcgaaatacaagccacattcggcttctctttcagaagaagagatcgacaagaaactcactgcctattttgcaacccatcctgtattgacccgtagtaatatgcagtcactctgttgttttacccaaagcatggccagcagacagattcgtcgtctaaaggcacaaggaaacttacagaatataggcaaacccacacagcctatttatgtaccaactccggggcattatgagaaatgatttcaacgggtatgagaaataagccaaattaaggtctatttgtgaataaagctatgagaaacactaaatttaaaatcatttctcatagcttacaccattaacaatctgacacttaggtcatatttatgagaacatgagaaatgaatattttatatccatttcagaggcgcatcaattctccaccaaccacttttctatatttcttgtttcaacactaaagttaacgccaatcttgaaaagtttccgcgaatccgttgcaaacggacgagcataatgtttatcctctatctgccgcaaagcttcttccgccgtaccattcaatttaaattccatgatgtagataaatttatcggtctgcaataccatatccacacggccctcactcgtatgatattccgcttttacatagaagcctaccagtttacacacgatatatagtacattctgataatgtaattccaattcgcgtgctagttcataaggaatatccgaaaagaaactttgcagacggcggaaaaaagattcgtaatcaccagcacgtacctcacgaacaaatttttggatttcaaagggagattccactttattgacgttcgcataataaggaagcagaaaacggataaatccttcctccacttcacgattaggaaaacctaaacggtaaataccaaattcttcatcatatcccttaatggtgagatatccgctctgataaatcaccggaataggattggtagattcagaatccatactgttcagtacctgttcatcggtttcttcatgggccatccgatgaaggtcgtaatggtgtttcttcagcaattccaccaaataagtgggagtacctgtttcaaaccagtagcttttaaactcattcctatcaaaagctaaaagcagactgaaaggattgtacattcctttggaattgtgcgtgaaatgatagccatcatacatttctttcaacctggcacatatctcttcatacgtcactccctgcacattggcaaattcatgaagttcggcatccagattatcgtatagctcctgttcgctcacaccacaaatatctatatacttattccacattgaaatgtcattcaggttattcaaatcactgaacacactgactttaccgaacttggtaactcccgtcaacaaagcaaacttgatacacccatcctgacttttcaatgcgccgtagaaggctttcaatgtattgcggaaactcttttgcaaaacatcatcaccaatagcctgtaacatcggcttatcatactcatccactaggatcaccacactttgcccctcttgctgacaggcacgcctaataatcccctcaaaacgcatcgctaaagatttatccgagggctcttcgccatatatcttctcccattccaccaacgccccattcagtttattctccaaactttccggagtatcgtatttttccgtattaagatcaagatgtaatataggatattttacccaatctttttccagcttctccatagccagcccttcaaagagttcctgctttccttgaaagtaagcttcaagcgtagaaataagcagacttttgccaaaacggcgcggccgacttaagatatagtaactcccggttttcaccaattgataaatcaatgccgttttatcaatataaaaatagccacctctacggagtttctcaaaattctgtataccaatagggtaaatcttgccacccatatttcaatctgtttaagttcacatcgtacaaatatacatattatctcaatataaaaaaccaaatgtccaaagaggaatcacattccgcatcccgtactcaatatcatctttcacgatatacgcattctccacatcatgcacctgcttctgcgatttattcttcccacctacttcaaaggtataaccacctattgtaaaatcagagacctctgatgtagttaccggacgtacaactcacaaagtagaaagaaattaaaaatgaacgataagaagaaatgcctaaggcgatgcttccgcatcgctgcacacgaatataaggatttttattacaataacaagcgataaacaatatttcttaaatgaaaagccgtgctccactcaacataaagtgacacattttacctaatagattagtgactgaagcatttttttatcacagcagtatcgcaataaatatagcttctctgagaatttataataatgactaggctttcgattattctcattaataatataattcatagtttgaagattgttcttctctaaaactcttctttcttttgctgacactggataacttactatcggcagacagtttttccattttgtgaaaaatattcgtgcattagtcagccattcattatctagctttgaattactaatgtgctctattagaatatcatatacacataatgatttcagtcccagcatataaacctgcaatgagatatcaagatcataaaaatgaaatcctttgtaatttatttcatcaaatcttattttatcaaaaacagatttcctcatgcaaaaaaaacatccatccactgctaccacttctatggcattcgcatctgcaatgggtttaaagcaagtattataagtaatggttggatcagctctattagtgtcaatagaatactggcaaattgcatcctttcctgcatctgtacttccaggtccccaccaaatacccggtatttgactaataaaacgtggtccagaaattccaataagccctactttcaaatctctgaaatgatttatcagaagctttccccaatcactagtgtaatgtaaaatatcttcatgcataaaacatagaagtggatattggctccttttgaccccttcgttataagcactaaatatatcatattgacttttactgttatcaatacatataatctcatgaacaaccccaaccgtattctcaatattatccttcaattccttagagatggattgaaacctactgcatattataatagaaatcatatttattcaaatcaattttatatattaagatacttttatacgaatatctctaattcataaaaaaatagttcacaaaactaaggataaaatcctgtaaggacaaacttagatttaaaaaaataaaaaactccagacttccaaagctaacagataaatatagaatgtagatcatccatccttaactcttcgaattcaattcttcaggaaagaaaatcctaacatatcacaattatttatcaaaacgtcttagtaaaagttttttttgcttatttttgtaagatacaatacaattctaacagtttggcaaggactattgtataacttacagttatgatagctttgagaaacatattagtataatttattttatatattctataaattatgaaatgttatatttgtttgacagactctattgtcaacagaaaagattactttaacatgttaaaggtaaccttaattagtgctcgtaaaaacacatctcttcgattaatttgcctatatgatggtaaaattggcgatcctgtttacaacttactaaaagattttaaagttgagatcatcatccatgaattaccatataaaaaggaactaatggaaatatattctcacgaatggatggaaacagaactaggaaaagatatagaatatagtcgaatattcggcacattcatgagaatggagattcctataatagaaaaagaagacgaatatgtattatacaccgatatggacataatctttaatgatgatatattactgaaagatctacctcatcctgcttatttagctgctgctcccgaatttgaacgcgatacaaaaagaatgagttatttcaatgctggaatattagtcatgaacatccaaggaatgagaatcaaatatcagcaatttgtagagatgatgaaaaaaaggcaaagatctacttcaggactttttgatcaagggtacttaaacgagctgtgtttcaaggacatggaaattttacctattgaatataactggaaaccgtactggggaattaatgggaatgctaagcttatccattttcatggaatgaaaccatgcagcaacctcgaagaagcaggatttgacaccagagaatcattctttcggactatatttgacaataacagtcaaggctatgcagggtatatatactattttattctcttttttaattacctaggtcaaaaacaagaccaatggttatgctatcatttacaatacatccttgacctatataaaaaacctttaatagcccttgcacaaaaaacagactataaaccaaaatacagaaaatacaaacgtctatactcaatattcgtaagtatctctatactattagcaattctactacttactgctttatttttagtataatcaatataaataacactctcaaatggacaaaaccgaaggtctaaaattaaaacaataaacatgagaattggtatattatatgtttgcactggaaaaaacttgcaaagatacagagtaagaactatagaaaaaacggggttcaccgaatgcttactacccatttgcaagacactcatgaccagaaataaatagaatttacttttaaaaagctcctgctaccggtaattcacagaaaataaaaacacctcaaacaaataatataaaataaatctttatatatttgccaataatatgaatcaaagcaataaataaaatgagaattggtatattatatatctgtactggcaaatatgacattttttggaaagacttttatctaagcgcagaacgttattttatgcaagaccaatctttcattatcgagtattatgtatttactgatagtcctaaactatatgacgaagaaaacaacaaacatattcaccggatcaaacaaaagaatttaggatggcctgacaacacattaaaacgtttccatatattccttcgtatcaaggaacagttagagcgagaaaccgactatctatttttcttcaatgccaatctcttattcaccagtcctattggcaaagaaattctaccaccatcagatagtaacggattactaggaactatgcaccctggattctacaataaaccgaactccgaatttacatacgagcgaagagatgcttctactgcctatatcccagagggagaaggtcgatattattacgctggagggctttcaggtggatgtacaaaggcctacttgaaactctgcacaacaatttgctcatgggttgacagagatgccacaaaccatataataccaatttggcacgacgaatctctaatcaataaatactttttagataatccaccagctattacattgtcccctgcatatctatacccagaaggttggctccttccttttgaaccaataatcctcattcgagacaaaaataaaccccaatatggcgggcatgaattattgcgaagaaaaaactctttatgggaaaggattaagctaatctgccaaaaatttaaatcggctgattagttatccaatttttctctattataaaaatacagaattatggaaaactcctttccactgatattcaactttatcatcacaaagaatcactattttatctgcactatctctcaataaagcaccatactttcccaaagtacctttacttgttatctgatgtttgcaataagctatcaaaaacaaatccatataccccttatctgaaccatttatatccaccaccttgtaattctcatttgcaaattcaagatagggaataagttctgatgccacccattccggctcatctgagaaaaagtaaaaaaaaggcataacagtctctttttccatataatcaacagcccttttaaaatagctcaaagaagcaggcttcccatacgctcgaacttcaacacttaaatcaccccgtcgaacatgcactgctacaggattgatattctgttttatttctgacattaacattttgctaccctcatcaaatatttcagatgagattctataagtagacataaatgcgggtacccaaatatttatcggcaaatgataatatccacctaaataaatagggggatttttttccaaaaatgaaaaatcatctatccattccgatgtattattcccaacataataaaaatgtctcttataataggagatttcgaactctgttgcaattgtcagccccaaataaggaaacactttcaacaaatcaaaattgcgggcaaatttataatccatgtcacttccccattccttataaaaggatagatcatacacaaccttacatccacgctttctaaaaaattctcccaacaaatattggagcatttgagaacaaataccaccatccatcaacactacaaccttaggagtaactaagcgagccttcaacattcttttataacaacttctttgccaccttctaataatactcatttctttatatcttattttaccaactatactgcaacagattcaaatcctccaaccagctagattataagcgataaacaatatatgcttcatttctcaacgccttaatttatctgagcacattacagtttatggcgcatattataatatctaagtttcaaatctccccagaaacctgatactctataagcattcacaatcttacgttctctttttgacaagttgtttattaaacaaggataggattccatttcattaacaagccgtttcatttccttcctaatatcagcaaaacgtttccaataaattcttctaaaggcattttcaagatggaaatgagcaagtgcttccttcatctcttccctcaacccttttttatcaatataattttcaatccatattgtataattcacaaagtctccatactttttatcatcaaaagttgctggatgtgacattgacgtattggtaaaattatagtcaataattatataatcaactgaaacgactttttgtaagtataacaataattgtgtggaaagaacgacatcttcaccaaatgatatatctggcctttctatttcattctgatataatgatcgaagatgaaattttgaccatacacaccaataagccttttttaaaagaatatttttcaaaaactccacgcctgacaactctacaaaatcaaaaaaagttgatttatgaaactctccatcatagcaaaacataaaaggggccactaccatatccgcttgcgtttcctctgctttagcaaccagcctagttattgcatcctcatgcataatatcatcactatctaaatattggatatatttgccagtagcaatatctatacccgatttacgcgcctgcactaatccttcgttttgtttattaaatacaacaatccggggatcttcagccgcatacgtctttattatatctaaactatcatctgtacttccatcattcactacaacaatttcaagattagtatacgtttgattaataacactctgcaacgttttagttatcgaattgtgcgcattataaacaggaataataaccgaaactaaagggtattctttttccattatatcattttttaattctttttcttggcaaagtgagtccaataataaattggccaaaaataagttatcttacgtaatcgtttataatatttagaagacaattcttttcttgacaaaaaacgccatctactcaacttgttcctcatatctttaatttcaacaggatacgactgatgattaggatccgtcataaacccttgaaaatgattaaagcaattttccacaatcacattgacggcatcaaaccaatctctaccttcaaacaaccgccgctcctttgcaaactccaatcttgaatattcagccaagaaataatgataacgttttataggattgattgtatggcaaatactatcacctctctgtatataatgataataagcagcatcaatccaaactattttatcgcaaatacttatccagcgataaatagtcgcatgatcctcaaaaaacatacctacaggaaagcgataagaatcaaaaaaaatcttatcaaaaagtttagtacaagctgaactacttactctctcaaaaataatatctcgctgaacatcttgactagtacgtacatacacattagctgtattaggatacatttgttctatacggccatcttcatactcaaagcaaaagttgcaatataccatataaactttgttctgtaccatgactgacaacatgttttcatacattgtcggttcaatataatcatcgctatctataaacccaatatatggagcagtcgctatttcaattcctgcattacgagctatagataaacctgcctcatcaagatgcaacacttttactctagaatcaatattagcatattcatcacaaatagaaggggaatcatcggtcgacaaattatccactaatatgatttctatatctttcaacgtctgattacgtacagactctatacaacgtcgcaaatacggagctgtattatgaacagggatgataacgcttaccgagtattgagattccatatttgaatattcattttctacttgcaaaaataaggaataatatccataggaagtatctaaaaagagattgtttacaaatagagcagaatttcacgcttacaattaaccattattaacaatacgtatatataactgaaaagccaaaagaaaaaattctatggggtattttgcattcagcaacttgctagtatagttttccatcacaaaagtttgcaaatacaatatttaaacaaactgaatgtgtatatttgcaaaacctaattgatagcaataaaaatgaaaaaattagcaattattataccagcttataaaccacgttttttgcaagaaacacttgattctatcgctaaacaaaacaatcacgaatttaccgtatatattggtgatgatgcaagtccctacccattagagaccatagtagatcgttacaagaacaagtttgacattatatatcatcgttttgaacaaaacatgggcaaaaaagacctacccggtcattgggaacgatgtatattattgtcagcagaagaacttatatggcttttttcagatgacgacttaatgccctttgacggagtagcacgtataattcgagcctcacaaaaacattctgaaggaaaatatatattccgttttcctttagaagtcgttgacgagtatggtaaactaaagtataaaaaccctccttttaaaaccgatttaacttctggatatgaattcctattagataaattatctgggaaaattagttctgccgcctgtgagtatgtatttagccgaacagtatgggagcaaacgggaggatttattaaattccctttggcttggtgcaccgatgatgcaacatgggctaaatttgcagaatttacaggaggaatcatatctttaccaggcaatcctgtcagctggagaaatgctgaaggagagaatatatcaaactccactcatttcaataaagaaaagattagagcaacaatacttttcatggaatggattagtataaactaccattcccatcttcacgaaagaaaattcaaaaaagcaatcaaacgttatatatataaattcctacagcattcgctaaaaaacgactttagcttacacgaccttttacttttatgcaacgctctaagaaaactcacactaaatgtatctttgctagttttagttcatcatgttgggaagaaaataaaaaggcaattaactcgcaataaataaattgccttatatttttgaatttaaggaatacccttgctaacaatatcctttaagaattttactataataactgtaaacggccatactcttcaattacttcaatagagatgacaagctaacacaataattatcgatagaaaactgctgtgcttttttcaaagacattttttttaacgaattgagcaactctcgatcatttgctaagatcataatattctttataaaatcatcgggagaagaacagaaacatgcattagtctcatcgcaatagtcccgtatagatccaacatcactaaccaccatcgccaatcctgttgccattgaagtacaaattacattacttccaatagtatccttcatcacatttaatgaaatatcagaatcattcatataatgctttaattccgcctccggaacataccccaccaatgttgcattctttaaacctgaaaacaaataatcaatattctcccgccctttgcatatataaaaatgaatttgcggaagtcttgaaacaatataagcaatctgttcaaagtcacgtgccaaagcacccattactattaccttgacatcaccacctctgttataaagatttgcagaaggagtataataattattatcgacataatgaaaggaagtataaacattctctattcctaaattattgagatagcatgtcaaactacttcccaatgttacaatttctgtaacaaatcgcgaactcttctttatttgtgctttcgaatatcgcctttccaatttttcaggaacaagatgcaccatagcatatataggtgctttaggacatataaagcgtattatttttgcaaacaatatttgatatgaatctctatgtaaatattcagtaagaacaaacttatctcctgatttatatgtcattgctaatttaagtgccgtaaaaagcacagagattttcttccccttttttcccttatccaaaaaacgcctacccatattgaaagtatacattttatacaattcaggatttcttttttgaatatattcataaagatacctcattcctgtatgattaccagatgttgaaggccaatcataacaaataatatatatcatattattaaaatttaaattaaagaacaatagtcttaaacaatagaggaattgcagaatttacatcagtcccattatttagacaaacacaatattctgaacaaaggtaatgaaaataatccaaagttttattctaatgaaattattctttctatatatagggcaagctcgggataagaaatcaataaaaaacgaaataactttcatcattacaaatattaaagtaactttgtaatcacctaatattattttgttattaatgattgaagaaaagtatgtgcttaataactctctcaatgcctatttataatgtagaaaagtacattgaacgtgccttattatctgcattaaaccaaacctatcaaaacttagagattttgatagtagacgatttagggcatgataacagcatggatatagtctaccaacttaaaagcacacatcctagaggtaactgcatccgtataattacacataaaaaaaatcttggtttgggaggaacaagaaacacagcaattgaatctgctcaagggaaatatctatactttatggatagcgacgatgctattgttcctgattgcattgaaactttatataatattatttcacacgagaaagtagactttgtagcagccggaatcaatcaaattgatgagaatgaaaattcactcaaaattactaactatcctaatattacacgaaaaggtaaattatgtatggctcaatacttttatgaagaaaaaaatgagatatgggtaactacatggaataaattatataatctttcttttttaaaagaatttcatattcattttttggaacacgtgtaccacgaagacatagtaatgcatgccatgctcgctctaaataccagatcatttagcctaaccaaccggacaacttatctttataattgcaagagagaagactctattacaaatatagaacaaggctacaccttgaagcatctaaatgatcttaccatagtttttagtgagatcaggagattgatgcaagcagacaacaaccttagcaaacatcttcaaaaagaaataaacttatattatttatttgaaatttatcatcgatacctaccagcgatgtactcaaatattaaaagggttgatttaataaaaggattagcaaggctctctcaaaactgtatccctcctattttggaaacccgactaacattcaaatctataaaacgttttttattcctaaaacttccttttagcattcagtatctaattaaaagtcataaatacaaaaaggacaaaacttaggcggaaaaactatcaacaaataatatactataagaaggttcatagaaaatattattttcatttacaaaatttacagtcttatacttcttaaaaacatggaaaagcatctcttcattcttagtcatttacaagagaagtttcatcataatgatattttgtatgtaagaggatgaatatagtcttttggaaagaagatttatacaaagccaatagttataatgaagagatgacttactagagccgcaaagacaacgaacttgcatgtagacttattaattccagaacaaaaaaagaatcataaaatttgatgtagctatcctgaaaaagcctttaacgcttgtcacaaccaaataaaatgtatacatttgtagaattttaatgcaagcccccttaactatttaactaacttagtaataattatatgaataaaccaatggcgagcaacataagtacatcgctaattatatccacctataatagaagcgacgcattagaattatgcgttaaaagcgtgctacgtcaatctctccttccagatgaaattatcattgccgatgatggttctaaagaagatacaagagaactaattcatcaattagcagcctcctccgaagtccctattattcatgtttggcatgaagatctaggcttcaggctggcttccatccgtaacaaagctattgcgaaagcatctaaagaatatattatacaaattgacggggatatcgtcttacacaaagatttcgtcaaagatcatgtacgttttgctaaaaaaggcagtttcgtaaccggtagccgtgtattaatccgggaaggtttaacccaaaagatgctagcagaaagaaactgcatgatctctattcacgacaaaggtactaaaaacacaatcaacggagtacatttgccttggctaagcccactacttcagcattatcgccaatgggatatttcatattccagaggatgcaatatggctttctggaaagaggatttattaaaagtcaatgggtacaatgaagctattaccggatggggaagcgaagatcatgaattagtgtgccgcctcatcaatagcggtgtacgcaagcgtaccatcaaatttgcgggaattgtgttccaccttcatcacgaactacatggaacggataatttgagcaacaaccgcagtattttgaacgaaacgaaagtcaggaaactaacctggtgcgataaaggaatcatacaaaactaatatggaaaagaatttgaactttttagatcgaaacgaatttaactacagtccatcaaaagaagtagtagaagctttaaaaaacttcgatataaataaactttgtttttatacccgcatttatgatgaaggaaagaaaagtatattatctgttttcttatccgaactttatgatatagatgaaacacaagtcttattaggatacggcggagaagatattctgaagcaagctgtacactacttcctgactcaagaagatggaaataaaacgatgttgattcccaagttctcatggtggtattataaatcaattgcagatgaggtgaatggccatactttgcaatatcctctctacgaagacggaaatacttttaaatatgactttgagacgctaaaagatatgattcagaaagagaatccgaagattcttttactagcttctcccaataaccctaccggcaatggtttaactccaaaagaattggatgaactgctcgcagaagtacccagccaaacagtggtactgatagatgaagcatacgcttcttttgtttcaactgatactagttatatcaaaaagctggttaataaatatccgaatttgattatttcccgtactttatccaagttttatggattgcccggtttacgtatgggattcggattcatgagtaaggagctggaaaaattcagcagatacagcaataaatatctgggatacaaccggatatccgaagatatcgccattgcggctctcaaatcggacgcacactaccgaaacatcgccaaactgatgaatgaagaccgtgagcgttacgaaaaggaaatcggcgtattacccggattcaaagtatatgaatcggttgccaattttattttaatcaaatacccgatagaactgaaagaggctttacaaaaggcttttgctgaacagagttataaagtgaagtttatgaatgaaccggatatcaatactcatttgcgtatcacattgggacgcccagagcagaaccggatcgttatagatacaatcaaagaaatagcatccaaatgaaagcagtaatattagccgcaggaatagcttcacgcttacgcccgctgaccgatacgacgcccaaatgtcttctcaaaataggagaacgatgccttttggaaagagcttttgatgctctgatacaaaacggatttgatgaattcatcattgtcaccgggtatcgccagcagcaaatcgtagattttctacaggcacattatccaacccaagatattactttcatctataatgacaggtatgaatcaaccaacaatatctattcattatggctcacccgttcctatacagatgggcaggagattttattattagacagcgacattgtatttgatccgcagattgtagagaaactgcttcattcggataaggacgacatattggcactgaatcgtcatgagctcggagcagaagaaataaaagtcatcgtggacgacgcacaaaaggtcgttgaaatcagcaaagtctgctcgatatccgatgctatcggagaatctatcggcattgaaaagatgtcagctgaatataccaaagcgctattccgggaactggaaattatgattactaccgaagggctggataatatattctacgaacgggcttttgagagactgattccgcaaggatatagtttttacgttatggacaccaccgagttcttctcggccgagctggacacagtagaagactttcaacaggcacagaagctgattccagccagtctttattaattaaaatcagatagaatggctaattacgacatccgccctctacagcttcgcatattaaagaacttattagctgttgacaaagtttgcaaagaacataatctgcgatattacatcatggcaggcaccatgctgggagctgtgcgccacaaaggattcatcccctgggatgatgatttggatatcggaatgccaagagctgattatgacttactaatggctaatgccaaagaatggttaccggaaccttacgaagcggtatgcgctgagaatgataaggaatatcctcttccgttcgcaaaggtgcaggatgccaacacaaccttaatcgagcgtatgcatctcaaatatctgggaggtgtatatattgatatatttccactagatggagttccggaaagccgtatggcgcaaagaatgcattttgcgaagtatgagttctacaaacgagtactttatcttattcatcgcgatccatacaaacatgggaaaggtcccagttcatggataccgctattatgcagaaagttttttacccttaccggagcacaggaaagcatcaggaaggtgatgaagaaatacgatttcgaccaatgcgcattagtctgcgattatgatgatggaatgaaaggaatcatgtcgaaggatatcctgggcactcccactcctatccggtttgaagatgaagaagtatggggagtacagaaatacgacgcttatctgtcacagaaatatggagattacatgaccatacctaaacaaagtggacaaagacaacataatttccattatttagacttgaataaaccttatcggaattttgaagtctaattataatcacataaaggtaagaagaagaaatgagaataggttttgacggaaaacgtgcagtacagaatttcaccggtctgggtaattatagccgctatatagtgaatatcctatgccaattctatccggagaatgaatatgtgctgtatgcccccaagaaacgggaaaacaagagactggacaaattaacgaagcagtatcagcaactacagctttcttatcccactacttcttcctggaaaaagttaagttcattgtggcgagtatggggcgttacccaacaactggaaaaagaaaaaatcgatatattccacggacttagtaatgagttgcccctgaatatacatcaaagcgaggtaaaaagtattgtaacgattcacgatctgatctttctgcgctatccgcagtattaccattcgatcgacaggaaaatatacacatacaaattccgtaaagcttgcgaaaatgccgataaaatcattgctatcagcgaatgtaccaagcgtgatattattgagtatttcaggattcccgccgataagatagaagttgtttatcagggatgtgatccttcattcatgcatcctgtagcagcagagaagaaaagagaaatccgggctaaatatcagctaccggatcactatatccttaacgtaggaagtattgaagaacgcaaaaacgccctttcagcggtgcaggcactaacgatgcttcctgaacagattcatctcgtcattgtaggacgccacacggaatatactgataaaattgaacgtttcattaaggagaataagctggaagaaagggtacatatcatcagcaatgttccttttgatgatctaccggctttttatcagttagcagaaatttttgtatacccttcccgtttcgaaggttttggtattcccattatagaagctctatactccgatattccggtagtggccgcgactggatcttgcctggaagaagccggaggtcccgactctatctatgtacatcctgacgatatcaaaggaatggccaatgctttcaaacagatatactccgatactgaaagaaaaaaggagatgattgaaaaggggcaaaaatttgccaaaagattctctgaagaaaagcaagcggaagaaatcttaaacatctacaagaaactaatgaaatgaacgtacttaaacatacaataaagaaatttatatatggcactctcccatattatttcatgaaaggatataagcctggctctccttatctgaaatactatgaatatattaaagaacatggatattcaagacacctgtatgaattcaaggatgaatacgccaatatgcctgttgatgtacagaaagatgaggaaaaaggcttatactatgttcaaaaagaaaagaagcgactctatttcagaaaaagcactccagccaagaaaattcaaaaatattatagggctttgagtatggaacaagacaggcgctcaccgcaccattacttcaacagcgttaaagaagtgacagggaaagtatttgtggatgtcggttgtgccgaaggatattcatcattggaaattatcgaagaagccaaacatgtttatttgtttgagcaggacgagcaatggttagaggccatcagagctaccttcgaaccatggcaggacaaagtaacgattgtccagaagtatgtgagcgatcataattcttcgagagagcaaacactagatgatttctttaacaaccagacgaatgaacatctatttcttaaaatggatatagaaggagccgaacggcacgcattggccggatgcaataacttattccaaaattgccagaagctggattttgccatttgcacataccatttgcgtgatgacgaagaagttatctctgcatttctggacaaacataactgcacatatattaatcaaaaagggtttttcaggcataaaatccgcagtgtagtgatgcgcggaagtaagaagtaatcattgataatcagcagaaagcaattcacaataatcatacttgcacaggtatgtatcatagatatgcttttcctttttcaataagaaacgtgagatatgcggttcccaagaaaagaatttacgtacggaacggtataaacggaagaataaaatcagggatacaatatgcttttctttctctttccgtgccgcacgacgataaatataatgagtaaaaaactgatcgctgtaacgaagggccagactgaccgtagattcgacgtcccatccacgcaaagaagcatattctgtcatgatgtaagtcagtacctcacgcgaaatacacaaacggcacatattacggcataccatatcacaatcaatatccgatagcaactgcatgcgattcacgtcgaccagagagaaactgtattcattcgtttcattctgatgaatcagtatattaccgggagaatagtccaaatggagaatacctgcctgatgcaaagcagcagtgtagcgcgcaaaagcagaaagtttatcttcatttccctctactttcccatccatcagggaacggacagtttcgccaccatcataacaacaaatataatagctatgtgaaagaagaccattctgaaattgttcaatcatagccactggctccggagtgtcaaaaccatgctgttggatctccatagaataaatataggaacgttctgcttttgattgccggaaaaacgaatatacaacgcggttgatgatgtgaggcttcttaaagctcttcaccacaacatcaatactgcccaagccaattcgttttaaaacattacgaccatcatacaccacatctctttctttctggaaggaccttggaatttcttctatctccttctgcaaatgtgcgtacttgggatttacaatcactctcattacactctcctatataatactaattacaaagattgagcaaagataaagaaattaggccatattccgactatatttttctcttttctcacaaagattggctaactctctctacatataagtcctgttacgaaccgctttagtcattttttcttttttcttttcatttatatttagacataaatgcttttttttagttatgtttgcacgataaaaagcataaggaagtttaagcatgaaaccaatcaaaagaattctaattattcgatttagacaaataggcgactcaattctggctgttgcattgtgcagcacgctgaaaaaaagttttcccgatgcagagatacacttcgtgcttaataaaaatattgctccactctatgaggggcatccggatatagataaagtcattacatttgacaagaatgagaataaaccattcactgcttatataaaaaaagtatggcaggtaatgcataaaaacagatacgatgtaatcatcgatatgcgctctactatccggactctttttttctctcttttttcattaagaacccctttccggataggacgcattaaaggatatacacattttctactgaactaccggacagacacttacagtaagaatctgacaactgacatggtacaacgcaatctattgcttgcagcaccattagaaaagatcagacctattcaatacacaaaagaattcaagttatatctgactgaccgggaaaaagaagatttccgatattatatggaaaaggaagggattgattttgcacgccctgtgttattaataggagtcacaaccaaactcatccataaaaaatggaatacggagttcatggtagccacactgaaaagaatattagaggaatacaaggacatacaaatgatcttcaactacgcgccggggtacgaagaagaagatgccagaaatatctacaaggaattaggatgtccggaacgtatcaagatcgatatacaagcttcttcattacgacaactggcagcactttgtgccaactgttcattttacttcgggaacgaaggaggagccagacacatcgcccaagctcttggagttccttcatttgccatttattcaccaagtgcgtcaaagtcaatgtggttacccgccaattccgtactcgccgaaggaattagtcctgacgacattcttccaccggaacaacaggcgacattaccctatgaggagcgttttgcattaattactcccgaaaaggtatacgagcaattgattccaatactaaggcaattgagctaactcccgatataaatcaaggtaggcttgtatatgcttctcgtaactgaatgaagcggcatgttccttgattttctccaagcgttccttatctttataaaaatcaggtagatgctcccggatactttccaccatagattctgtatccaaatgttcccacatgatagcgtgtccattacaaacttccggcaaactagtgcgattagcagcaaatacagccttcccaaattgcatagcttccaccaccggcaatccaaagccttctccctcactaggaaacaggaatgcctcacagttccgatataaccagatcttctcgctttgagaaataacatccgtcaaaaagacattagtgagctgattctcacggatcagattgcgcacttcttcagcataagcaaaatgagcatcgccacaaatatatagatcatattccgggaaatgacgcattacgtcaaccaagagatggaagttcttttttctacggatttgtccaatcgtaaaaaagaaaggacgccctgtagcaaacgacggctttattccttccaatgtatcgattctctccactccattatagatgacccggatctccttccctttcaaatctacatgctgccgaatgacatctgccacataatgagagatcgtagtcacgaccgctgctttattgaccttattctgcatccggcgaagatacattttcgccttccagggctttttctctgttaagaaattaaagtcgtgtatagtaaagataaactttgtaccaccggcaatacgcaacagcttgcgctgttgattcaccgcatgccatacatctaccttgggaagggtaaaaggaaaaaacttattgatacgacgtaccggaacagaggtcacattcggaccaaattcctgcatatatttctgccgcaataaatatacaaaatgaagatcatctaccggcatagacgaaaaggcggttgcatagttggccgcaatctgcccgaagccggctgtgagactaccataattcgtaagatctatcagtacctttttctttcgttgtatctctttcatcattatttgattctacgctctttcagctcaataaacagctaatttgaacttcagcaaggattaatctacaagcccttctattttcgcaatgacctgctccggctttatatccctcaaacaggcataatcacctcgccagcaaggcttctgaccatatacagaacagggacggcatgacaaatcgagttgcacggtattgaccggcaattgtttccaacccataaaaccggcataaggatgggtggctccccaaatagagacaaccggaatattgaccagggatgccaaatgcatattggcagaatccattgaaagcatcacgtccagatggctcatcagattcagttcggtacgtatattcagtttaccgatcattgaaacgacagaaggatatttagcaatccatgcatcaaatacgtcctgctcgcttttaccgcctccaaagaggaaaacctttactttgggattggcagcaaaatgtgctataacttgctcctgcagttctaacggataaatcttacctgcatgtttggcaaaaggagctataccaatccacttttgatcttctttaggccctgtgactggttctatttccgcaaagtttccttttccttcgccataaatagaagagaaatttaatagtaccggtaaacctagcttctcaagtacatcggcataacgacgaaaagaactcttctgattttccatcaccttatcatgacggcgaaccagcttctttttgcctgcccttcctttacaaatggaagctaccggtttattggcaagacggaatcgcaaacataaatacttagaacgaagtacatgatgaaaatcagcaatgtaatcaaaatgcattgctttcaattccgaataaaggctattcaagccccaaagccccttgtgcttgcctgttaaatcagctccgacaaaacccacattggcaggcaacccctgaaagagtggctgccatacagcacgacttaacactgttatttcatgctgcgggtattgcacagccagcgaatgtattaccgggattgtcatggctacatcgccaagagctgaaaaacgaataatgagaatacgcgccattcgttattttttcgcataaagcaccggatttaatgccgggtcattatacatcttcatctgtttatatactttcatatattttcttccggcttcgatatcagccaacaactgttcaatagccgtagaaaggtctttgcgttgttccagcaggatattcaacttagtctggcattgagcacggtgttcctcggtagtgtccgtacgttccacctcctgctgcatgtggtaaattttcaatgcaagaattgacaagcggtcaattgcccatgcagggctttccgtattgatcgttgcgtcagagagaggtttcacctctttgtatttgtctaaaaagtagctatcaattaattccaccaggtctgtacggtcctgatttgatttatcaattcttcttttcaaggccaatgcttctaccggatcaatctgcgggtcacggataatatcctcaaaatgccattgcacagcatcaatccagttctttagatataaataatactcaatagttttcaacccgtaaggattgttcatcggagcatccacactatccgttacatggtaatctgttgtcgatttccaaaaaatctcgttgcaaaggttactaaatgtcataatcttaactagctaatagatatataatagggcaaatctatgtaatatttttcagacaagcaaccgtttcttacttttttatttgttacctttgtgggtataaaagatgaattgtatatgaaaattattatcgacaataaaataccttatataaaagaagcggtacagagaatagccgatgaggtagtttatgcaccggggaaagatttcactccggagctcgtacgggatgcggatgcacttattgtccgtacccgcacacattgcaaccgggatttattggaaggtagtcgagtgaaattcatagcgacggcaaccataggtttcgaccatattgatacggagtattgcaaacaggccggtatcgaatggacgaatgcaccgggatgtaattcggcttctgtcgcccaatatatacagtcatcgcttcttgtatggaagtccgtcaggaataaaagactgaatgaactgacgattggaatcataggagtaggaaatgtcggaagtaaagtagctaaagttgcccaggattttggcatgcgtgttttattgaatgatttgccacgggaagaaaaagaaggtgcagaacgattctcttcactggagaaaatagcggaagagtgtgacatcatcacttttcacgtacctttatataaggaaggaaagtataaaacgttccacttggcggatgaagttttctttcagtcactcaaacggaaacctgttatcatcaatacctcacggggagaagtcatccagactgatgctcttttaaaagccttgaacagccggatgatttcggatgccatcattgacgtatgggagcatgaaccggaaatcaaccgtgatctactggaaaagacatttatcggaactcctcacattgcaggttactctgcagatggaaaagcaaacgccacacgtatgtcattggatgccatctgcaattttttccaaataaaaggggattatgaaattaacgcacccgcacttgtctcccccattattcatgcaaaaaaccacgaagaagcagtcctccaaatgtataatccaaccgaagacagcaaccggctaaaaaatcaaccggagctattcgaaaccctacgcggagattatcctttgcggagagaagagaaagcatacattattaagtattaggtattaagtttcaagtaagtatcagacattaatcgcatcgactgaaaaatttaataaaattctgtcaaaggattatctgtacgacgtaatacttaatacctgatacttaattcttattatttaatacctgttctatgatttgcgggaagtgttcatattccaaagcatgcaccttcttagctacatcatccggagaatcagtcgaaagaacagggcaagtagcttgaaaaatcgtatttccttcgtcgtaatgctcatttatataatgtatagtaatgccgctttctttctcaccggcagccactaccgcttcatgaacccggtcaccatacatccccttgcctccaaacttcggcagaagagcaggatgtatatttataattttatcgggataagcatgcaaaagtaaatcaggcacacgaaccagaaagccagccagcacgacaaaatcaatgcggtactcctgcaaaatagccaaaatttcatctccggctatccaatcctcctttggaaacacgttagaaggcactcccaggcgatgcgcacgttccaaaacataggcgtcacttttattagaaagcaccaacgaaacctgaacggaatcgtttttttggaaataccggataatattctcggcatttgaaccggaaccggaagcgaaaattgcgatgtttttcttcataactctcaaattcgatgcacaaaacagtgaaaaatgtgcaaaacattgcatttatttagtcaaatatttgcgcaaaacgataaatattcattcctttgcaccgcaaatttaaagaaataaaactaattattaattaaaaacttaaagttatgtctgaaattgcatcaagagtaaaagcgattatcgttgataaattaggcgtagaagaatcagaagttactaacgaagcaagcttcactaacgacctgggagcagattctcttgacactgtagaacttatcatggaattcgaaaaagaattcggtatctctattcctgatgaccaagcagaaaagattggtactgtaggtgatgctgtatcttatatcgaagaacacgctaagtaattcgatttcatcaatatggaattaaaaagagtggtagtaacaggccttggcgccattactcccgttggcaacagcgttcccgaattttgggaaaacattgtgaacggggttagtggagcagggcctattactcattttgatgcgtcgttattcaagacccaattcgcatgcgaagtgaaagacttcgatgcaacgaaatacatagaccgcaaagaagcaagaaagatggacttgtatactcaatatgccatcgctgttgctaaagaagcggtgagtgattccggtcttgacgtcgagaaagaagacttgaacaaaatcggtgttattttcggcgccggtattggtggtatacatacatttgaagaagaggtaggcaactactacactcgtcaggaaatgggtccgaagtttaatccgttcttcattccaaagatgatttcggatattgcagccggacagatttctatcatgtatggtttccatggtcctaactacgcgacctgttcagcatgtgcgacttcaaccaacgctattgcagatgccttcaacctgattcgtttgggtaaagcaaatgtaattgtatccggtggttcggaagcagcaatcttcccggcaggtgtaggcggtttcaacgctatgcacgccttgtcaacacgcaacgacgaagcttctaaagcttcacgtccgtttagcgcaagccgcgatggtttcgttatgggcgaaggtggcggttgcttgattctggaagaactggaacacgctaaagctcgtggtgcaaaaatctatgcagaagttgccggtgtaggtatgtctgcagatgcacatcacttgactgcttctcatccggaaggtctgggagcgaaactggtgatgataaatgcactggaagatgcggaaatggatccgaaagaagtagactatatcaatgtacacggtacatctactccggttggtgatatttcagaagcaaaagcaatcaaggaagtattcggtgatcatgcgttcgagttgaacatcagttcaaccaaatcaatgacaggtcacttgctgggagctgccggtgcggtagaatctattgcaagcatccttgccattaagaacggcattgttcctccgactatcaaccacgaagaaggtgacgacgacgagaacatcgactacaaccttaatttcacgttcaataaagcacagaaacgcgaagttaatgttgccttgtccaatacatttggatttggtggtcacaatgcgtgcgttatcttcaagaaatacgcagagtaatatcgtgttacgtaacgaaatagataagataaggctcttgttccgcaaggatagagagtcttatctttgtttttaccggatactcgggttctacccgcgcaatatccagctttatgagcaggctctcctgcacaaatcgacttctgtccgctccgacaagggacgtcctctcaacaatgaacggctggagtttttaggtgacgccatcctcgacgccatcgtgggagatattgtctacaaacgtttcgaagggaaacgggaaggtttcctgaccaatacacgttccaagatcgtacaacgagagacgttgaacaagttggccgttgaaatcggcctggataagctcatcaagtattctacccgctcctcttctcacaacagctacatgtatggaaatgcttttgaggcgttcatcggagctatttatctggatcagggatatgaacgctgcaaactgtttatggaacaacggatcattaaccgttatatcgatctggataaaatatcccgaaaagaggttaacttcaaatccaagcttatcgaatggagccaaaagaacaaaatggaggtttcctttgaattaatcgagcagtttctcgatcatgacagtaaccctgtattccaaactgaagtacgtattgaaggacttccggcaggaacaggtacggggtattccaagaaggaatctcaacagaatgccgcccagatggctataaagaaagtaaaggaaccgacatttatgtcaaccatcgaggagattaaaatacaacattcggcaactgaaacggaaacagaaatggaagttgaacttgcgacaggttctgatactgaattggcaaccgagcttgagaatgaactcgaaaccgaactgaatgcaaatcccgagataaaaccagagaatgtttcagaagaaaacatcctcgtcgatgagatttccacagtacaggacacagaagctccggcaactaaccaaaacaaatccccatgcgacgaccctgaatcaccaaatcgtgatcttcagtaaccaatttcagttttcctgcaacttcttcaagaggaatagatgctatatcgtctccttttaaagtcaccatacgcccgaattggccattggctatcaattctgttgcatgcccgcccatgcgggtagaaagattgcggtcgaaaggagtaggcgaaccaccacgctgaatataccccagaactgtttcgcgagtttctataccagtttcatattcaatttcctgcgcgatatattcagcagcacgtttacgcccgtcagtctgaattccttccgctaccactacaatagaatagggtttgcctttctttagtctttccagaatcgtattgccaatatttttaatgttataagcgatttcaggaacgagaatcacatcccctcctcctgccataccggaatacaaagcaatccagccagccttatgccccatcacttcaatcaccatcacccttttatgagagcttgcggtggaatgtagacggtcgatggcatcagtagcaatacttaccgccgagtcgaaaccaaaagagatgtccgtgccccaaatatcattatcaatggttttaggaacagatacgatgttaactcccattgcaacaaacttggctgcagtcttctgcgttccatttccaccgatacaaacgacacaatccagcccaatttcatggatattctgaagaattaaagacggtttgtcaacatcagagacaacgcctccttttttgaaaggcttctcacgagaagttcctaacatcgttccacccagattgagcaaaccggagagcgacttgtctgtaatagattcgacatctttagtcagcaagccctgaaaaccgctgtgaatacctaccacttccattccgtaataattgatggcagttttgcacacgccacgaatcgtggcattaataccgggacagtccccgccggatgttaagattccaattctcattgtcgcattttttagtctaaaactcgggatttatatgaaagtcgtcaatttttaacgattatttccgtcgtaaagatagaaaaaaaagataaataagttacttttgcacgactaaacattattatgttaaagcagaaatgaatattacaaaaattattagtaagactttcgattcccgtttaaaacagatagacctatatgctagtcaggctagtgagatacagcatcgtgtgttaagccgcttaacacgccaggccgctcagactgaatggggaagaaagtacgattattcctctatccgtaactatgaagatttccgaaaacgtgttcctatccaaacatacgaagaaatcaaaccttatgtagaacgtttgcgagccggggaacagaatctgctttggccatcggagatacgctggtttgcaaaatcctccggaacgactaatgataaaagtaaattccttcccgtcagcaaagaggcactggaagacattcattacagaggaggaaaagacgcggcagctctttatttccgcatcaatccggatagccattttttctccggcaagggactgattctcgggggtagccatagtccgaacctcaactccaaccatagtttagtaggagatttatccgctattctgattcaaaatgtgaatccgcttatcaatttcattcgtgtacctagcaagaaaattgcattgatgagcgaatgggagaccaaaatagaagcaatcgccaacagcactattccggtaaatgtgacaagcttgtccggcgtaccgtcgtggatgctggtacttatcaaacgtgttcttgaaaagacaggaaaacaggctttggaagaagtatggcccaacctggaagttttcttccacggtggagtggctttcactccttatcgtgagcaatacaagcaggtaattcaaacaccgaaaatgcattatgtagagacttataatgcttcggaaggatattttggaactcaaaacgacctctctgatcctgccatgttattaatgatcgactacggaatcttctacgaatttgttccgctagaggaagtaggaaaagagagtccacgagcttattgccttgaagaagtcgagctcaacaagaactatgcaatggttatttctacttcttgcggcttatggagatacatgattggggatacagtgaagtttaccagcaagaatccctataagtttgtcatcacaggaagaacaaagcatttcatcaacgcatttggcgaagagctgattgtcgataacgctgaaaaaggattggcaaaggcttgtgccgaaaccggagcacaagttagtgaatacaccgcggcacctgtatttatggatgagaatgccaaatgccggcaccagtggttaatagagttcgctaagatgccggattcagtagaaaaatttgcagcgatacttgatgccacactgaaggaggtcaactccgattatgaggcgaaacgatggaaagatatagctctgcaaccattggaagtaatcgttgcccgtgagggattattccatgattggctggcacagagaggaaagttgggaggacaacacaaagtccccagattaagtaatacgcgcgaatatatagaaacaatgttagcgctgaatgacagcattctttcggaagaataaccaaaaaccaagacataaccgacactagttttctttattacagagattacttgtacaaggagagcgtttcgaagcacctctccaatttcttccaggcacggattatgcgaattacatggataaagtttattctctttccgtgtttatccgtgtaatccgtgcctaaattatgtcggctaattaccgggcgttgactattatccctcctcccaataataagccatctttatagaatgcagcagcttgtcccggagcaatggcggttaaaggctcatgaagttgcacatgcagtagatgatctggtgtaatggtaatcgtagcatggttttcctgtttgcgataccgtattttcacaatgatgtcagaatgccctaaagtacgctcctgattgacaagattccagtctttcaaccacatttctgttttctccagagctgaaagagaagctaatactacttcgttcttttcaggattaatctctttcacaaatacgggacggttcaaatgaatgcccaagccacgtctctgtccaatggtataaaaaggataaccctcatgccaggcaataaaatctcccttttcatcgacaaaccttcctcgtttcactttattgagtcctgcctgattacttccaaccaatgcttgattctcccccatcatctgctcttcttctgccaatgcctcattattttgagccaaccagtttttcagaaaagttcgatagtccattgggcaaaaacaaacgcctatactatcctttttagttgccaccttctggaacccatgttccgcagcccagacacgagcttccactttcgtaatatcccccatcggcaacaacatcctgcaaagaatatcttgtttcaatccccatagaaagaaggtttgatccttatccgagtcggcagcgtatgttatataaaaggtattatttagttgtatattctgtgcataatgcccggtagcgatatagaaaacacccatttcatcggcaattttagcaagcagaggccatttcaggtaattattgcacaatgtacaagggaccggagtccgtcctgccagatactcctgcacaaaatattcaataatctgtttactgaatatttcacgggcatcgtatgttatatgccgtattcctaaacgttctgccagattacgggcatcttccagatactctgtcgagccattcaattcataaaaacggaaggttactccgatcacttcataaccggcttccagcaatcgcatagcagcaacagaactatctgtaccgccactcattccaagcaatactcgtttgttttcctccatcatgctgcaaaattaagtattttcccgtatctttgtttgttaaagtctaaaagagaatgaaagagagaccaactaacggacaagttataatcgttttcacagaccatccgatactcggcatattgctgattccctatattgcggaaaagctggacgatggtaccttgcaattggtagaacaagcatttcacgcctctcccgaagctatgagcaagatgagtgagtcagaaagacaagctattcatatcgcctcttattatacagagaagcatctaatgagagtctactcccgcgaaaaaacagtatcgcgttttttacataaattatccgaagatccggaacgaataaagaatgatatccgtccatctatcgaaaagaaactgttggaaatgctgatactgatacgggacaacggactgcctttttatcagaaacaagccggcagtaaaatactatacgcccatcatgcctatcacataaatcctcataatgcagaaattcgtgtaacgtttcatgttgacaataaaacgtttcgttatcagttgcagtgctattatgaaggacagccattctctttaagtgagttgaaacctgtggttgtactgacatccgcaccagccacgctattattgggaatggagctatacttctttccgcacattgaaagcgcacgcatcttaccttttacaaagaaaagatcgatcagcgtagacgcttcccaaattgaaaaatacatagataacattgttatcccgattgctcgttatcatgaaatcgagactcacggtttgagtataatggaagagaaatgcccctgtgaagcaattctctcattcgaagataccacgtacaacggacaagcattgcagcttggtttccgttatggagatcagacatttacatcggatagtgcccttgaaatgaaaaaaatcatttatcggaaaacatccggtgaaatcttcttttttcgccggaacattactgctgaagaacaagtcgttcagctcttaacggatgcaggcctgcaacaactcaataatacacatttcagcctatcccctgaagctccggagaaaacgatcgtcgaatggatcaacagccatcgggagatgttgcagcagtccttccatctcaccagcaatatgggaaacacaccttattgcctggacgagatacgcatcgagcaaagttgtgacgatgaggtcgactggtttgaattgcacatcaccgttgttatcggcaatctacgtattcctttttcacgcttccgcaaacatatcctggaggaaaagagagaatatctgttacctgatggccgcatgattctcctgccagaggaatggttcagcaaatatgcgaatttactagagatgggaattcaaacggaaaaaggaatccgcttgaaacatacatttgtaggtgccgcacagaccgccttaggtgaagaggaattaaagaaatttccggtgaagcaacagatacaaaatattgccgtacccaaaaacctcaaagcaacgttacgtccctatcagcagaaaggattctcatggatggtacatttgcataaacaaggatttggcggatgcctggcagatgacatggggcttgggaagacactccaaactcttactctattacagtatatatataaaccatctacccccagacaaccggctaccctgatcgttgtccccacatcgctacttcataactggcgacgggaagccaaacgctttacagcactctcgatggcggaatacaacaacaccatggctatagacaaggaacaaccggaaaaattcttcggtcattttcacttgatctttacgacgtatggcatgatgaggaataacattgatatactctgttcataccgtttcgaatacatcgtgctcgatgaaagccagaatatcaaaaatagcgaatcgctcaccttccggtcagccattcgactacaaagtaaacaccggcttgtacttactggcactcccatcgaaaactcattaaaggacctgtgggctcaatttcactttatacaaccagacttactgggtacggaaaatgctttccaaaagcagtttataatgccgattcgtcaggggaatgcccgtgcaaaagtattattgcaacaactgacagccccatttatcctccgtagaagcaagaaagaggtagctccggaacttccggcacttaccgaagagaccatctactgcgacatgactgaagagcagaatacttgttacgaacaggagaaaaacagcctgcgcaacatccttcttcagcatcctcaaagtaccgacaggcttcattcgtttagtgtattaaatggcatcttacgtttacgacaactatcttgccacccgcaacttatccttcccgactataccggaacatccggaaaaacggcacagataatcgaaacattcgatacgctacagagcgaaggccacaaagttttaattttctcctcattcgtcagacatctggaggtgctcgccgaagctttccacgaacggggttggaaatatgccttattaacaggatcgaccaacaaccgtccttccgaaatcgcccatttcaccgatcaaaaagacgtccaggcattcctgatttcactaaaagcaggaggcgtgggacttaatctgactcaagccgactatgtatttatcatagacccctggtggaatcctgccgccgaatcgcaggcgatcgcccgcgcccatcgtatcgggcaggacaagcaagtaattgcttaccgcttcattacccaaaacagtatcgaagaaaagattcttcacctacaagatgagaaacggaaactggcagaaacatttgttactgatagtgagccattacctatattaagcaacgagcaatgggtagacctgctctaataatacataaagtcgcaatctatcacagagacgtgtaaaatgtattatttcatcgtattcctgaatttttttatccatatactcttattttatccggttatctttgccattgtgaaaattataaataacccgaaataataaacgtatgaaaaacaggagcattacctacctattactatttggtatttgcagcatgttggcaatcatgcaatcgtgccagaaaacagatgacctggaagcagacatcaattctctgaaagaccgtgtcgctgctttggaaaaagcaacggaaggactgaatacttcatttgccagtctgcaagcccttatgcaaaaaaacaaagtcattatcggaattactccgactaaagatggtctgggatatttgctggaacttagtgacggaacaagcattaaagtcatggaaagtgaagcagtacaggcgtctgtccctgaattttccgtagacgaagaaggctactggatatataaaacaagtaataatactaatttcaaatatctgccaggagccgatggagagaaagtatcagcatggccccgtgatgaagaaggcaatgtggtggcaactccattaatcagcgtatcttccagtggatattggcaagtgagctacgataatggacaaacgtatacaagcttaggaactaaggccgaaggtggaagtcagggaggaaccagtatattcagtaaggtagaatataatgaagcaaaccatactttctcattcacattatccgatggaggaaaaacatatacctttccggtagatgacacctttggactgataatttatggtctcaatgatgccgacagcgaacaaactgtgcaggttttcgcccccaatgagaatcataaggaatataaagtagaacagaatgacgtacaacaagccgtagtacaagctcccaaaggatggaatgttcttttatccgagaacttgttaactatcacaccacaagcaactgcgacaaaggatatggaagaaactattaaaattgtactgacttcatcaaagaattatatccgtattgtatctattgaagttaaacaactttccagcgaagccggagcagaagcctggcagcagtttgttaacgctgaccaacagaatgtgttattagacttttcatacgccggatataaacatggtgaaatagcacctcctgaaacagaaacattaatagcacaaggatataaagtatatgatgttacagatcccaaatacggagctatcccaaacgacggcaaatctgacagagcagctttcatgaaggtattggaagaaatagcaagtgaaacaaagcaagaagacctcaatatgaccgaccgatatatcaaggaaaatgctaaagctattatctacttccccgaaggaaattatatcctgcaagatgaggattctaaagatcgcagaattcgtatatcaatgagtgatattgttttaaaaggagccggaagaaacaaaacaacactcgaaatgactgctgcaaataattctccgaaaccaacagaagaaatgtggaatgctcctgtcatgatggagttcaaacacaatacaggattaaaagaatcaataggtgttatcactgaagatgctcccataggcagcagaaccataacagccagtttaaccggagtaagcgcaggcagttgggtatgccttgtattggaaaatacggatgacaatgtaattaactccgaattatatccacacaaatgggaagatattaagatacagcaaggcggtactcccaatatcaagacaaaagggattcagatatacgaatatcatcagattgagaaaatcagtggtaatagtgtcaccttcaaagagccgatcatgcacgccatcaataaagattggggatggaatgtacataaattcgccaattatgccaatgtgggtgtagaagaccttacattcaaaggacatgccaaagaaaaattcatccatcacggctctgacattgacgatggtggttttaagctcatcgattttgtgcgtctgaccaattcgtggatgcgccgggttaattttgagagtgttagtgaagccatgtcaatcacaaattctgccaactgttctgcttatgacatcactattggcggtaatcgtggacacgcctctatccgttcacaggcttcttcccgtatctttattggaaaagtaactgaaaacagcaatggctacacacttagaaaaggagaaggtgaaagcacattgatggaatataaaacgaacgttggccaatatcacgcttgcggcgtttcaaagcaaagtatgggtgctgtaatatggaatgttagatggggagatgattcttgctttgaatcacatgccacacagccacgtgcaacactaatcgactgctgttccggtggtttcatgcattggagacaaggaggagactctgctcaaatgcctaatcacatggagaatctgacaatatggaatttctacgcaacaaatgcacaaacagaccaggacatcgatacaggaggtaaatttacctggtgggatggtaacggcttttggtggaaatttatgcctcctatcattgtcggtttccacggaagtcctttagattttgatgatactcaaatgaagcggctcgaaagtaacggaactgctgtggaaccatattcactctatgaggctcaattacgtaaacgtttgggatatgttccttcctggctatcctctttaaaataataactttaaaacaatataatcatgaaaaaagtatggagtatgttcatgttattggctgtatgcctggtagcatgtaccaacattgacgatttggaagatgatgtagacgcactgaaaaagcgcgttaccgcactcgaaacacaagtacgtgatataaatagtaatactgaagctcttcgcgaactttataatgaaggaacatttattactaatatagaggaaaagtctgattcctacacactcactttgagcaatggaaagacagtaaatctatatatgaaaaacgataataacctgttatgccctattatcggtattgattcagaaggctactggactgttctttacaacaaaaatgaaactccggagcgtctgactgtaaacggacaacctgtgaaagctaatggagagagtggcaagactcctacattcaatgtagatagtgaaggttactggcaggttagctatgacggaggaaagaattatagttatatatacaaagaaggaactaacgacaaagtcagcgcaaccggtgacggttctgctccgacagaagacaaaaacttcaagagtgtaacagtagaaaacaacgaactggtcttagtacttgcaggtgaagatgctccaaccatacgtatccctatcgttcgtgatttcgaatgtagttttgcagccgaagatttaaaacaagtacaggagttttcggcaggtgaagtgaaagagtttaccatgaccgtgagaggagtagaaaatacaatgattactgctcccgaaggctggagtgctaaattctctaaggaagctggaaaagaaaatgtattggttgttactgctcctgcatcaagcgcaaagatgatgactcgtgcaacagctgataacagtactgatattgcggtattggcaacaagtggaaagtatgctatgattgcaaagattcaggttagtatcaagaatcgtacggattataaggctgattttgataatggtaaagacattactatcggcggcatcaccatcaacaaccaaatttattcagatgctgacatacaaatattggatgcaacagatgccgatgtagcacttgatacttactttagtgccacaatgagtaaaccagttatactgttcctcacaggtacagcacacaattttaccacagccggagtaaaatcaatcagtaatgatgttattatcatcggtcaatatgatgacgagcaagtaacacttcgtcctgctaattgctggaaatcatgcaaaggaaagctactttttaagaatataaaaatagatttaagtgatctcaatggaggtagcaatgcaggttacttcataaacaatgcaggtattaccaacagtggagacttcactgacatatgctttgacaactgtctgattgcgaatgtcttgaaaccaatttattacgatgcagcacaaaagggatattttggtataaataacatttctgttcaagacactcgtattgaagttaatgctataaaaattgccttgataaatatatataaaggtttcaatttaggagattataaaactttcaacttcaagaacaatattgtgtatagccagacacctcaagaaggcgtacaaatattaaattgggctgcaggcaatactcctcaatcagatggtgtactttctgccgaaattctaaataatacttttgtcaacatggtaggtagcaatatattcttcagataccaaaaaggaacatcattgactataagcaagaatatctttgacgtaagtccagaagcagaattcggctcctactattattctttcttagaaagttgcacgcctcaaatagatgtaaccgataatatcgtatatggcttaaccaaaaattggaattattatcatacaggttctcaagttaaagaaccagcaagcagtaataacataaccaagcacgcaacagctcctattactcaatatgattatgtaaatggaatatttacattagctagcgatgtagccggttatggagcaacaattgaataaaactcttttaccagtttaataataaaagccgcataacgaaagttatgcggcttttatctatctaaatgtcatatcatcaatcaagaaatcagaaacaggagaagctactacatcctaaaaaatacgggtctggttcaaaaagaaagcccctgcatctgatacatgacagcgcgaggactcgaatatatctaatacagatgaacctgtaaaaacaatatccaactttgaatgataatcgtaaatcaaattaagctctttcgaccaatctttatttttataaatttcatcaataaacaagtacttgcctcccatctttacaaaagcatctgccaagtcgaacaaacgatggcaggcttagatacgattatttgcactataatagtgcaaataacaaaacaaattgcactttcacagtgcaatttcagctaaaaccacatcttttcccccaccaccttgcagaaaaacttttttaatttatctttgcatccaaaacaaccctacatgaaatacaaacttatcgtgctcgatcttgacggcacactcaccaactctaaaaaggaaatcactccccgcaacagggaaactctgatacgtatgcaagagcaaggaatacgactggtattagcttccggtcgacctacttatggtattgtgccattagctaatgagttacgtatgaatgaattcggtggattcatcctgtcctataacggaggagaaatcattaattgggaaacacaagagatggtatatgaaaatgtgttgcctaatgaagttgttccagtgctctacgaatgtgcccgtacccatcaactaagtatattaacctatgacggagcagagataataaccgaaaactctcaagatccatacgtattaaaagaggcctttctcaataaaatggcagttcgggagacaaatgacttcctgacagacatcacgcttcccgtagccaaatgcctcatcgtaggagattccgataaactgattccacttgaagccgaactttgtctccggctgcaaggtcgcattaatgttttccgttcagaaccctattttctcgaattagtcccgcaaggtatcgacaaggctctttctttggccgtcctgttaaaagaaataggagtagcacgtgaagaagttatagccataggtgatggctataatgacctatccatgattaagtttgcaggattggggattgccatgggaaatgctcaagaacctataaaaaaagcagcagattacatcaccctgagtaacgaagaggacggtgtagcagaagcaatcaataagttttgcaatcaacaatagccaaacatctactgacatgccggcagagttttagtttctcggtgagaaacctttggtttcaaggaatgaaactattggttcctcggtgtgaaactgttagtttcataccgggaaacaaatcaaattaccggtaaaaacgatccgacacttaaaatcaaccgattaaagatagggcgcatattcagattttatactaactttgcggttccaataaaacaaatataaaatgttatggaacatcaacttaccatttacaacaccttagatagaaagaaagagttgtttgtaccgcttcatgcacctcatgtaggcatgtatgtgtgcggaccgactgtttacggagatgcccatttaggacacgcccgtccggctataaccttcgatgtgttattccgctatctcacccacctaggatataaagtacgctacgtacgaaatattaccgacgtaggtcatctggaacacgatgccgatgacggagaagacaagattgccaagaaagcacgtctggaagagttggaaccaatggaggttgttcaatatttcctgaaccgctatcataaagcaatggaagcgttgaatgtactttctccaagcattgagccacatgcttcaggacatatcattgaacaaatccaactggtacagaagattttggatgccggatatgcctatgaaagcgaaggctccgtctacttcgatgtagccaaatacaataaagattaccactacggaaaactttccggacgtaatctggacgacgtattaaataccacccgtgacctcgacggacaaagcgaaaaacgcaatcccgccgacttcgccctttggaaaaaggcacaacctgaacatatcatgcgctggccgtctccatggagcgacggtttccccggatggcacgccgaatgtaccgctatgggacgtaaatacctgggtgaacacttcgatattcacggaggaggaatggacttgattttccctcaccacgaatgtgaaatcgcacaatcggtagcttcacaaggcgatgacatggttcactactggatgcacaacaacatgattaccatcaacggaaccaagatgggtaaatcacttggcaacttcatcactctggacgaattcttcaccggtactcataagctgctggcgcaagcctatacaccaatgacaatccgtttcttcatcctgcaagctcattaccgcagcacggtagactttagcaatgaagcactgcaagcatccgaaaaaggcctgcagcgtctgatggaagccattgacgcattggataagataactccctcatcgacaacttcagagggaatcaacgtgaaagaactgcgcgctaaatgctacgaagcaatgaatgacgacttgaatacaccgattgtcatcgcacagcttttcgaaggcgcccgcattataaacaatatcattgccggtaatgccaccatctccgccgaagacctgaaagacctgaaagaaacatttcatctgttcagtttcgacatcatgggattgaaagaagaaaaaggctcttcagatggtcgtgaagcagcttacggcaaggtagtagatatgttactggaacaacgtatgaaagcgaaagccaacaaagactgggctacttccgacgaaatccgcaacacactgacagcactcggatttgaaatcaaagataccaaagacggtttcgaatggagactgaataaataacaagaaaagaaagtgcccaacgcaccgtataactgcagagaagaccggctcaacacgaaccggtcttctcttttttcatagaaacatgataactaataccctctctttaaattcttattttctcttatcttattcactaattatttattttccatgagcatttcaaccggctgtccatgctgacaagttaccgtcagtacggtctgatctccctgctgttccaaccggacattttccatcggacttgtcaatgtccaatgccctttaagccgtatctccttagtaataggacgactgggttctttcgttgtatacgtcttctcttctatattcagattcggatcacagacgcttaaacggatccccttatcagattcttttgcatacatcaccattgtttccgcaggaatagccacgaacactttatcagtggcaggctgataagcttcaaaagcagcatacgccgtgataccagtctttttatcataaacaacgtgagctgtctgatcccgttgcaacacctcgtatgcaggagttttgcgcagttcgtcgagatcggaagcagaaggctgtatcaataccatatattcataagtcccctctttcggcgccttgccatgttctatccaggcagaagaaaattttcccttagtaacttcacgcgtcttttcgtgccgtgattcctgttctgccacctgtgcgcgaacggttccgtccactacatgataataattgtcataaccatcatgaagccaatagttatcctctcctactttgggctccttaccattatattttgtctggaaaagagtcgtttccgtaggataatccgcattggagttcgaaatacctgttcccaggcaaaccatccggttatcaaaacagaatacggatttacgggccacaaagtctggtgtgaaattctcataatcccgttctgccaatttcatagcgaacattccatttttaccatctaaagaactgcttccggagaaattctctttggagcgtgccatagtcgttcctttcaatgggctatcaagcaaatcgaaaggcaaatgaatggtagttgtacccggcaaacggttccagtcccatccctcctgcacaaaaccgcttccggcacgtgacacgggatttcctttccccataatctgcacggagccataactctgataacgtccgtaacggttatctttcgtataaatttcagaaccccatacgtcagtggtatatcctttcaatgtcaccatccaatctgcacgacggaaaatgcctgccgaaccatagttgtaaacgaagaatccctgtggagcctgtgccggttgaataccttccttcttgaagaaacgcgcattcggagtatcactattgcgtatcagacgtaaatagtcagcagccagaccacgatcaaacgtatttccctgaccggacaaatcgccggataaagcgatattggcaaatgcttcgatatcatcgcttcccatcttccctccaaaaggatgacggccactgattccgatgccccattcatagaaattgcaataattgcgcatagcaataaaggctgatttcatgtgtttgcgcgcatcttctgtcagttcaaagcttgtaccattggtaaatgcaatatattctcctacagtcgcaagtactccagtggtatatcccggatagaaaccgccatgatggaaagtcgtaccgtctacctttataccaccgatcgttcccggagtataacgcaaagaagaagatagccaacgtgacaaaccactcaacgcttgcgcctgttctcttgcatcgggaaacatcatagcggaaataaatttcgccatcaataacgtgtgccaggaatccaacaattcgtcacgtgttggagagcatggctgacgagtttcttgcagagccgcccaaaaacgcaatgtggagagataagcatcccgatgaggatgtttatagatagcatcacgcatcagccaggcagttgtatatatcttacgtacctgataaccataatgatgattggtacccataccgctaccgtatgcaaatccctgatcgatagcatagtcgaatacagtaaagtagtttttctttgatgtttcgttctggttataataagcatcataggcaaagccggaaagcatcgtttcaatatcgttccatgacatttctcctttcttcttgtcctgttcatcaggagcaacaataggagttcctataaatcccgttccggcgatggatggactgatagccgctttctcaaatgttttatagccagcattaatcggtccttgcggagcctttttcacttccagaaagtcagtcaaacgttgttcgatagtcttcaattctttcttttgttcgcttgacaatttagaaggcagagggatatcatacgactgttgttcccatttccacacgagacaccaatgccataggtcacgattagacaatccattattggcaggcaactgctggtcgggagtagtacgaagattcattttcttttcggggaaagtcaaacgatcaagaaagatacgtcctttccgttgcggggcaaccagtcgataggctacgattttcttatctttcttatctccttgcatatactcaaaagagatccaacaagcccgccaacctgctgcctgtaaacgataagagaaccaataagagacttctcctgccttattcagaaactcaaaacgaatagaatcctgctgcggtttctcattataaatccacaaggtaatgccgaattgcttctcatttctcgcattcaacgataaaggagcaatttgaatgtccagcgtagaaccaagctgaaagtcccattccagactactttcaccctccttgtaaaaaagagaagagattttcacttctccctttccggaaactgtaaatgcttcgggcacttcttcttcaaatccgatgagttgagcgaaagctgaaggaatgattcccaaaaggaataatactataaaacaactgtttttcattactattttcaatttaaacgcggatgcggattaacacctattattgtcgcagagatttactcctaaaattggcacttatttgcgttaatcagcgttttataaattactaatcgctaataaggaatccgatccgacagaatcttttccgtataccaaggatcgttaatctccttcaacatagctcccatttcaccgcaaagttgtgccacaatctccttattttcttccaaaggcaggttatgcagttgatatggatcttttacatcatcgaataagaggcttttcttcaattgcttcgtatcacggtcgatatataacgccaatgtatattgagccgtcttgatacctcttgaagaagggaagtaagtctgcaccaatccattttcatctttatcaccatctacattctgaatatacagtgcacctgtaggacgaacaatttcagccttttcatcgaagaaaagaggagcgaaattacgtccctgcacttccgccggaatagaatcacccaatccgcacaagccaagcaccgtaggcataatatcaggagcggagagcaataaatcatctaccctcggctgaatcttaccgggaaaacgaaccaggaacggaatattcatggattcagaataaggggaattcttcggatcatcagtgcgctggctacacatcgtctcaccatgatcggaagcaaagattacgactgtattcttatccaatcccaattctttcaatgtcgtcaaaatctgtccgaaagcacggtctactccggtaacggaagcgaaataataacgtgcagactccgctttcttcatcttcaaatcgacattcggacgaatcaacagactatccagaggctgatctttataaagattaaaatcctgctcttcacagtcattcaaggagcgatacgggctgtgaggaggattcatgcccaccattatgaagaaaggtttcttggtatcacgtacgttaccgtcatttttcagataagaaatgactttgcctgattcgtgcaaaggtgaccattccttcggatcgtgtctcttaccatccgtatcccaataatgcgggttcttgtgttcgtcaaatgttccgtaagaataccagtagttaaagccgtgccggcgttctttcggtgtataggcatcccatgccggacgtttttcttccacatactgtcccggatgttcgggatcgttcggagtcgggaagtcagcgtgaagtttaccaaaataagcacagtcataacctgctttgctgaacacatcgccgatacattccgcatcctcgcgcaaggagctgatcggacgtgtagagttgcaattcaatggtacaccacttttgttcgggtacataccggtcagtaacattccacgatgagggctgctcaacgggcagttactctgtgcagacgacaagaccatagattcacgtgcaaaggcatccagattaggagtatgcacggggtctccttcaaagtttactttatcccggaatccgtcctgcctccagaagcccatcgcctggttacggtattgatcgggaaatacatagattatattaggatgctccgcttgttgggacgcttgtttcggagccttgcaaccttgtgcggcaaagagcgtcaagcctcctacaagaaggtttataggtttattcatgatagtttatgataaataattaaaacaggtaaatgacaaacggtcaatagaaagttatagataataagtagcgaatgataaacggtaaacatgttccgtcagaatccgctaagcattcaccgttcactgtttaccgttcattgtctatttcttatttcttttccaaatctcttttacgcatcagtccttccaggaagtaatagtcagcatagttcagaggaacgtcaatttcctgaccgtgaggaatactgccaaccgaatgcatcaggataaagtttccatttgttccaacttctgcgcgataagcaggtgagcccaaactttccattatcttatcagccgtttccttgtagtggttgcccggcagatagccatccagttcgtaaagggcagaggctgtacaagctgctgcagaagcatcacgcggttcgttcggaatattcggagcatcataatcccagtatggtacgaggtcttccggcaggttcttattattaaagatgaagttatagactttttgtgcctggtcgagatatttcttatctttggtatagcgatagcaggtagtatatccatacagagcccatgcttgtccgcgagcccaagccgattcgtcggcatatccttgtgcagtttgtctcttacgcacttctcctgtctccggatcgtaatctaccacatggtagcagctgttgtccggacggaagtggtgagccattgttgtatcagcatgtttcactgcaatattgtagaaagtagaatctccggaaagagctgttgcttcaaataagagttcgagattcatcatattatcaataatcaccggacatttccatccccgtgttccctgccaacctttatcggcatcccatgactggataacgcctgcattcggacgaaaacgagtggacaatgatttggcagcttctataatgacgtctttgtactctttcttatctgccatgcgatagccgttcaaataactgcaaccgatcatgaaacctacatcatgatgccatttcagatatttcacagaatcaagagcttctgtatatttctcagccagcggcaaccatttcttatcacccgtcagattataagtcaaccatatactaccgggaaagaaaccggagcaccagtcttccatcggtatgtaagagatactcccatcttcgttgattgttctcggattcaagattttaccggacttctcaataatgtccgtctggattgtgttctgtgccacagcgttgtcgatgttgtcctgaataaagtctacttcaacctttttttgtccaccgcaactcgtaaagatcaatagggaaagtcctaatgcgctaagaattgttttcataatacagggattatttgttaagtgattaattttcctgatggcaaaagtagtgcatttaaatagaattgaccgacctaaataatccaaatgaaggacaattttggtacatttcactgaaaaatgaaggaatggatagaattatatattcaaaaaaaacagagtccagatacaaagaaagtatctgaattctgttttctcaattatataatattgcaaactatatctataattcgaatggctacagatgagttgccttgttcagccaaatggctaatccggcttcttactttaaactctcacaaatttccgtatttgccctcttcaatttctgttcatccagttttattactttgcggtcgtatgtcatcaatccgttcacttcgatctcaacatctgtagtctgtgtataaacagcagccgagaatccgcgtgcaatcatatccttcagcatattagcatacttcagatactcatcagtagcttctttggaagtactaaactgaacatacccccaattacgattcggctcccaaagatgctccttcagcactaaaccaattcctccatactctccgagtacagttgcacgctgtgcgtcatataaatacatctccggaccgggataattatgcaaatcgagcatatcaccacaggtataatgattacctccactggcaggattcactaaacgggaaggatcatattgctttgtccattctgctatttcaggggttttaaactgcccccaagcctcattgaaaggtacccatgtgccaatacaaggataagagtaaaggcagtcgataatttctttccattctttacgataaatagcctctgattcagcagaccgtttaaattctgttccctcaaaatacttccgattctgccactcgggattcttatcaccactcggcatgtcctgccacacaataacccctaaacgatcacaatacgtataccaacgggcaggctctacttttatatgtttgcgaatcatattatatccaaaatcttttgtcttttgaatatcatatactaaggcctcatccgaaggtgccgtatacaagccatccggccaccagccctgatctaaaagaccaaattgaaacaagtccttattattcaattgtagacgtacaattccatttttatcgcgtttcgttgaatatttacgcatggcagtatagctcttaaccttatcgatcaacttattttctgaatacagacaaatttccatatcatataaaaacggagaatccggtgaccaccactttacatcagacggcatagcaatttcaaccggaataccatttacggaacttcctacagccaccaactgctttccttctaataccttcacctccaatttatctgaaagcatctgatgatctgtcataacctctactgtcaacttattcctgtcaatatcaggagtcgttttgatattgccaatcgaccggattggcacaggttctagccaaactgtttgccaaataccactgacaggagtataccagatacctcccggcttactaacctgttttcctctaggttgaggacctttatcagtcgggtcccacactttcacgatcaattcattttccccattcagcaaggcaggcgtgatatcaaaagaaaaaggagtaaatcctcctgtatgttgtcccacctttaccttatttacccaaacatccgctttccagtcaacagccccaaaatgcaataagatcctatgtcctttccatttggagggaaccgagaattgacgctgataccaaagttcattcttctccccaagacttttccccactccggacaagcttgattctacagcaaaaggaactaaaatccgaccatcataactttgtggcatagcttgacctaccggagaaatagcataattccacaatccgttcagatttatccagtcagcacgttccataattgggcggggatattcgggcaacacgttttcaacatctattttcgccgcccattccgtcataattcgaccgccaaccggtttccactgtgcaaatagataaacactattaataagtatcactaaagaacatacaatttttctcatctacattatttctattaagagtatttttactaggtcaagttattccaatataatatcaaactgatcgtacggtgccgtacgatgcgccaaatgcttagtcaattttgaaatcccaaacaagggagaataagtacgtactttgatcgttttaccatccggcataaattccagaatgcgaagccaaccatcccctccgttcccttccggaccgcctcctacatattgtacattaaacgtcatttgtgatacatctttcccggcactgttcttatccacccgataagccacattattctcatattcaccggtgcctcttcccacatgtccgcaaagtacgagacggatattggaagaaggataaataagtttctcccaaatagcctgccccgagttttgtggagaaatcttatacccatctttcgtaacacgcttattacctatatcaagataagaatgagtgataaaaatcaccttatgattcttgtatttcggcttgtttaccaaatctttcgcccattgcaaaacttcatcacgaggcacaaactctactgctataaccaaaatctttccccatcccggctcatcaaactcaaaagccgaattctctaaagacgccctgccttcacgattaggaaattcactgacacagatattccgccaggtagaatttcgttcaaaaggaatataatcaggaaaataagtacgaccgttttctgcggctttgtatccataatcatgattgcctgcggcaataatataaggtactttgttatccagtcttttcaaagcctgcgatgctgcctcccacatttcacgactggtctggttcagcatcttacggtttaatacattattatcattctgctccaccaaatcgcctgtacaaaggacagctttaattttaagcgactctatattgtccgcaatccatgcggtacaaagatcaaaaagcggctggttaatatcatacttggtatatccctgtggatcaccgagcaaaatcatagaaaaggattccggattgaccaatttctggggatcagcccgatgctgcgccgggagacaagtgacagaagcacacaatatcccggccaataaatagttgaatagtttcatagattactctttttcttcttcgtttttaaatacaggtgcacgagatacggatgccggtgtgccattagtaatataaggccagccatcactgctccattgtatgcggtcacacatcaattgacgaccattatctattttcgctttctgccaggcatgatagaagaaccagtcattaccctcgtcatccgtgataatttcggaattgtgtccggttccggcaaacaggttattaccctgtagaattacttcattataactactattttctttcatcacagtaccgtttttacccacataaggaccttcgatatttttagaacgccccaccactacacggtacgtacttctttcctcttcacaacaactacccgtagagccaaatagataataataattcccgcgtttatgaaccatgatgccttctattgaaggacccgctatcttttcggaaacagcccctttaatggatagaccgtcagcacttaactctacataacggatacctccttcatagcctttagaagtactattataacttccccagaaaagatacttcttaccattatcttcaaaataacaagggtcgatgcactgcatagtaccagaattgtagtcaagaagttttccgtgatccgtaaaaggtcctacaggagagtcgctgaccgccaccccgatacaactattcttaggcaagtcccagtgcccgagagtataatagagcacatatttgccattgatatagttaatgtccggagcccataagcgagtgtccggctgccagttcggtttttgcagaaaggctgccccagcataagtccactgtgtcatattagtagatttgtaaatcggaatatagatattatcctgttgggtaacatacaaataaaagttcccgtctgccgcatgaattattgtcggatcaggcaactgtttgccgactataggattggagaatgaaacagggttaggggtactccccccacccccatttccattaccgttacccggcccatccggttgttcgtcagagccaccggaacatgccatgatacacaatgctgttgcaattaaaaaagataattttttcatatatactttattagttaaaactaagattaatttatccaaccttcattctgttccaaattcgagttcatttccatttctttagcaggaataggccagctccagcactgatctcccaaccagtaccaggtataagtcgtttcaccccacatctgcatcagaccgttacgattattatcaaacttcttatctttccacgttccccaacgcaattcatggaaatacatggaatcttcgccaccgatttcccagtaatactcattccggatacgttcacgcaaatcactctgcccgttaactttcgtagcaggataagttgcattattcaattcgacatgccctgcacgacgtcttacttcattaacacatctaattgcttcgctttcatgggtacttccccattcatttagcgcttctgctttcaggagcaatacttccgcatagcgtattaatggaatatccaatccataagtatcacgttctgtctgttccagaccttcaggtacaaactttctccataggtagtaaaacttatcgtttgtatcagtacggatatcaaaaggctctgcactgtcggagccacgataaggccaacgcaatgtataagtatgagctattccagaagaagcaccattgtattgtgcgtaaggggtaatgacagccatttgcagacgtggatcacggctctcgtaagctttcttgatacgtgcttcattgccactatccagatatttgttcatatctgccccataggcagccatacgttccttttccgccgcagacagtccatcgcgtagaaaaaacaccacacgttctttttctttcatcgcactatagcccggcaagtagttatcccaattaaacttttctccggtcgccgtctcaaaagattctacaaaatgcggattaggcaaatagttattccacatagaacctgctgtacaacggttgccgtaagtgatgttccttgtattggagtagccgtattgcttgatgcattgcacagagaatatcatttcttcacattgttcatttgctattttcaacaactgcttataactggtagcaccggccttagtatataacccgaagccacagtcagccacagaattaaaatcatcaaccgccgcctcccaattcttctgccacatatatacttgtccgcgtaatgcataagcagctcctttggttacccgtccatagttagagtcacccgaattatatttacccggtagattgggttcattcacacaatctgtcagatcctggagtatagccgcccaaacatccgcttctgaagaacgggctttgttaccgttttcaggactcgtgattgcattcatatataacggcactcctttatacaagatattcaagcgcatataagcaaatgcacgcaagaatttacattcggcgatagcccgttgcttctctccggtcgacatatcaggaacctgaccaatattatctatcacatcattagcacgatagataaaagtataaaaacgtttataaatatcactgaacaggccacttgagggagtagctgctcctgtacaattaggcattcgcttaatccagttcttgtctgtatccatcacagaagaataagcatcccatggaatccggtgcgaatccaaaatgccggagttaggacaatattgatccagaaagacattatatacgccgataacagcctgttcggccaaagttgctttcgtccagatactactaccgcttatgttattggtaggagtagtatctaaaaagtccgcaccgcatccagccatagagaaagacagcaaggcaatagatgcacatcttactaatttccgaaatatttttattttgtttttcatcataaaatcgttttagagtaagtttagaaagtgatatttacaccgaatgcatattgtctcatagtagaatatcccactgcggtacgcatttccggatccattccttcatacccggtaatggtaaataaattttcaccggaagcaaagaaacggatattctgtgcatatacttttttcgacaggacagcaggcaatgtatatccgatagtcaggttcttcagtttaatataatcccctttttgcaaatgtactgatgactgtgtcataccactttggtcgttaccggagttatttgtcaaacgaggattctttgaactcaagttcgtgcgcggatcattgggatttttgggatcaaagaaatagtgatcgtttgctattgcttccccaatagcatatcctttgatggtagcactgctgttcaatgccaaacgatagtagtaaatcttgaaacctgccgcaccggaccagttcatggagaaatcgaagcctttccaattagcgcttgcctgcagaccgaagttatacttgggcacattggagcatccctgaaactcattatcagcgtcattaccatatacaccgtcgccatttaagtctgcatagatgtaatcaccataccaaatgccactcttactgacgttctgacgcggataaaacttataccctgcccctaccatagcattcagccatttcatgtcgtctactgtacggatcattccgtctctcggaccaccgttgatattgactgttccatctgcgttaaagccgtttccattacctttatatggttgcaacatatagtattcattaatcattttaccttctattacacgggtagatcctccggtagagacatcaccgatattggtttgataaacacggttcccgttttcatctgtcacccagccacgctgcaactctcctttgtatttactgaccttgttctggttataggcaaagttaccggatacacgatattctactttaccgatacggtcttgccaattcagggtcatttcaataccgcggttagtcacttccgcaatgttctgacgagggccactggctgtcccgagagacatatacatatcagggcgatataagattccatccgttactttattataaaattcagcctcaaacgtcagacggtttcttaaagttgcaaagtcgataccaatattcgtaatggcagtactttcccactccaacaggttgttggaaatagaagtaattgccaaaccattattaaggctacctccaaacgcgtactttgccgagttgtacacagcctgccattcatagttaccaatcgcattgtttcctaacttaccccacgaagcacgtaatttcaggttgtcgataggaagtcctttcataaatttctcttcactgattctccatccggcagagaaagatggaaaaagtccccagcgattatccggagcaaaacgggaggaaccgtcataacgcatattaacctcgaataaataacggctgtcgaaagcatagttaatacgaccgaagtaagaacgggatgtaaattcctcacctgtaccacctatggaagaaggagtagtagcagaacttggatcacccacagacgaatctattaatccaagtttggcagtgtcggtagtccgtttgacaaaacgttcttcttcaaagcccaataacataccaatatcatgcttataaaaagtctggttatagttgagcaagtgcgttaatttccaatggttttcacggacatacgccatacgggtatacaaatcggcaggatctttgggggcagctatccactgatctgtactaaaactatatttcccataatccgtatttacggacatcgattcataacgataatccttatagttcagattaacatcgtatgagaagtgtttcagaaacttcacgttggcatagaaagtagtgaagaactgcgtgttcttgatatgcccttccgattgcgccatgtcccacagaggattgtgagattgcggatcttcctcgttcgcttccggcgcaccatattttccgtcataatatggatatacgcccggtatcattttttgggtattgatattggtgagtgaaccggtatcgcttttcttctggtcggtgtgatacccccatacacgagtaccgatacgtaaccacttagtaatatccgaataaacattggcacgcagaaaatagcgttggtatccggtatctttgattaatcccgggttgtcggtataagatatagaaagattatatccggtacgtccctcctgcccagtgacggaaagcgaatgtttcatcatccagtcattactatatatctcatcgtaccaatctgtattgggataagctacataattaggatagccggaggcagaaatgccattcggatctttttcagcttcacgccattgattgatggtaatgtcgctgaaaggagcagattctcctatattagtagcagcttcgttcatcaattccatatacttggcgtagttagataccgtttttatcagtttggtaggttgattcagtgaaaaagtagcattgtaagatacgctgacctttcctgtttgtccggttttggtagtaaccagaataaccccatttgccccccggttaccatagatagcacacgaagccgcatctttcaagatagaaatagaagcaatatcattgggatctacattattcaagctttgttccatcccatccaccaacacgagtggtgaagagctgttcaaggtacccaccccccggatattgaaagaaaagccttcattatatggagtcccggagctttgcatcacctgcaaaccggctgtcataccgctcaacgcctgcgaagcactgaccaaaggacgggaaagtgattccttttccaaatttaccgtagcaaccgaaccggtcaggttcaccttcttttgcgtgccataaccaaccactactacttctgaaagcattttcacattctctcccattacaatgttgaatgtcgtcttgccgggcgacaatgaaatttcctgcgtgtcaaaaccgatataagacacttgcaatttcttagcgtcctccggtatttccaattcaaatttcccttccatattactcaccgtgccaatattagtaccgggaattgataccgatactccaattaacaattcatcattgacatcgctgatgacaccattgatacgccgtttcttatccgatttctgaacgacaggccgggtgataataatatgattatcttttattttataaattaattcctgccctttcagaatctgatccagtgccttgcttatcggttgattatctaccttcacggttactttacgggtcaggtccacatcatttttctcatatactaaggatacatttcctttgacctccaactcccggaacgctttgcgcaccgtcacgtcctgcaaatgtaaggtcacctgctgtgcgtgaaccgacagtggaagaactgcggctaatagcacgaagaacatgcatttgatgattttactcattgatttaagtttttatatgtatatcttttgttactaactcattgtcttacaatgttcttatttaaacattatccaggattgcgaactagcttcattatccgcatttttcacattgccattcgtttcccaatcgtatctgccggcaactttccctaaaggtatccctctattatcatcccgaatgacaacaggactatggtagttctcaccaaacacaatggcatccgtacaaccaacttcctgtaacgccaccgctacttctcgtaaagaggaaccatcactaaagacattccaagccgcttttaccgagttataagaatttgtaaaacgattacttatgaaaatgaccaagtctccttcttccgtgataccgacagcccggcgtcctacaggcttgccatcaaaagtccaaatgcttaccggattagcagcccatgaattacttcctgacaatgctccatccattcctctgttacgggtcgaagtatttcttccttcattagtggcaaatgtcttgtaaagttctgcattttctccggcaatcatgatctgccctttttgcaacggataggaatatccactgacagcactggttggagaccactgtaccccattggcagcttgtttgccggctccgccgctggtaaacttatacaagttattatctatcacttctgcatacgaaatctccgcttttccatcagctgtaattcccagagttcccggacaatacttcaaagaagtagataggttatatccgagacgcggtgcggatagcagcccactatcattccacccgaggctataaaatatcggtacccagaattgcccggacaatcccggaacaaacaatgaataatccatattatcattcatgatagctgttgtacgatgttgagcagtgggttcagcccatgttacattgtctttattcatatcccagctaaccttcatatttattctaccggcaggaatagttatcaaccatcccgtattaccgctccttccatgcaagtttttattttcatagacaatcatgaaatcaggaatacaaatactactgtgttggctttttagatcagcagtaatatttttccagtttacccctgcgtcaataattccatttacagcactcaactgatattttttagtcatgttgttcgtattgtcttttacagtaatagtaagtgtgctacttaggtcaacaatcaggtttccgttttcatccttttgactgacgggatccgtggagatgatttctgcgttatctgccaaggtcggcatcaacactacgtttacaaatgcagtgttttgtttgaaacgtaacgaagcgatgccattaataaagttagcactaacctgctctgtgttacaagtagccgttacgcctcgaagtagctgagtagaagtgctgaaaatggtatattcgatatcatctgctccatcattcactttaatacgggtgataccgctgctcaagtccagtacagcatcagtagtgagcggatcaatgggctttgcccattcatccgccagtttgagtttcacattcaccgcactttggtcgtccaaaatgcgaaaatctaaggctatgaccctactgttctggtcaataagaccatttatccagttccctgtgccatcttctgcctgtatggctaccaatggttcttttacgtaccccggatcttcggataagacaacacctttcagttcatcttctccgcatgacgtgaatataaacacaaggaatgtgcttaatagaaaatgtagtttcttcatacaatattatttaaataagaaatagcttattttctgttattcctgaaaacaatctttatcctgcatgactaaactaaaacagctgtttgtataccttataacttaaaaaagagtgtcgcgctatgctcttttacaatccttctttttaccattcatagagattcaggttaaaatatgctttattggcctattcattaatatgacagccagattaataaaaagtatagtgagaaatgatttttttattcgttcagcccttcaactcatctttttattagtgagtttggtcatcttacattttttcaataccttgcccccgaattatccatcggagaaacagaacctgtgagtattcaccttaatatattaactaataaatcaaatatacgatttctgaaagacataatggaaaaaaacctggaaacagagattatcgaggccctgaaatcgggtaaagaggaggcattccgatacatctataaaacttactatacagatctttgccggatagcgagagggtatttgacagactcttatctatcagaatctatagtagaagatttggtgtatagtctatgggaaaaccgctctaaaataacaattaacacctcattgaagaactaccttttcagaagtgtagccaataagtgtatcaattatcttcagcttgaatatgtgagaagggaaacggcctgctcgtcagaagacctggtcatttacagcgatttatggtccttgggcgaaaatccggttgagcatttagagggtaaagagctacattctattatccagaagacgattgacggcttatctccggaaacccggaaggtatttttattgagtcgttttgagaacaaaagacaagaagaaattgccgaaatcatgggaatcactattcatacagtgaaatatcacatgcgaagtgcactggataagctgaaagaagcagcaaaatcttatcttgccctgattgtaatgtttattacgaatatatttaattaatattaaaaagcaaagtaattcactatacttcttctattgacaaactgtcctgatgatagcgcaggtatatgattttcaatagatattaagtttaagatggtatgaaagaagaatttgacagactgatatatgatttcctctcgggaagtatcaccaaagaggacttgcataagttgaacgaatggatatactccgatccggagaatcagaaatattttgaacagcagaaacgaatctggcttctgtctgccgagtataaaaatgtatctgtacacgaagaacaagcctataacagatttgcgaaacgaatccgcaaacataagagtgctccggcaggaaagatgagaagagccttatttgtgaagtatgcaggttacgcagcggcaatcattatattactgtttaccactccttttataatttataattttacaacacctgatgattctttgatttccgaagtatacgctccaagaaaatcgaaattaaaaatgaagcttcctgacggttctatagtgtggttaaacgcagattccaagctttcttactccgagagttttagtcgaaagaatcgcaatgtccggctggaaggcgaagggtattttgaggtagagcatggagagcatccatttgttatacaaacagactccgcacagatcaaggtactgggtactaagtttaacgttaaaaattatggtgatgagaattatataaaggtatcactcctagaaggttccattgtcttattgtgcatcaaccaagagtttataatgaagcctaatcaaacgatgacagttaataagcttgaccaaacttataagctgaccgagagtgctgactatgctgaacagtggatcaactgcaaagtattctgggatgaagttcctatgtcgatcatttctaaagagttggagcgccagtttgatgtgacattcgcatttgagtcagagcaactcaagaatttgattttccatggaagttttattatagaaacaaataatttggagaaaatattggatattatgtctgaaacaaataaatttagctactcaattgaaaaagataaggtatatatctattcattgaaaaaataagaaacgattaaagaatcttcaaaaataatatcatgaccgcacaagagttttttaagaacgatctgtttgccgaaaatgcaggcgtagtgctgctggaagtacgcaaaggttacagtaaagccaaattagaaataaaacccgaacatcttaacgcaggtgcccgcacacaaggaggagcgatctttacgctggcagaccttgcgcttgccgcagctgccaactcgcacggcacactagctttctctctctcgtccactattacttttctgcgtgccagcggccccggagatactctctttgccgaagcacgcgaacgctatatcggtcgaagtacaggttgctatcaggtagatataacaaaccaagacggagagttgattgcaacttttgaatctagcgtattccgaaaggatcagaaagtgcctttcgaagttcaggaataaaacaggaaagcgcatcaacacttttaaaagtataccttttagaaacagataacgcggatgatacggataaaaagataataaatccgtgtcatccgcgttatccgcgtctaaaaaataacaggttggcagggccatttacttctgatatgccttcgttttttctctatatctatttaacgatagaagtcagcggatgccggttacccgtcacattattcaggaatgcttttgccgaaccgaagttcaggaataaatccagacggacaggaagatggttcaagtcgtccgtcacgaagaaagtaatcacctccttttcttttcctttcttatcatattctaccaatgagaagatcaggcaacggtaagtaactccattctccgctttcacattttcttttccacggtagataagcgtttgctcttccactttacggcccgtagccatcgggaacttgattttgtctcccaccttataatctgcagggtcgtaagaacgtgcctgcgccaagatgcttaacatatcgtatatacaacggctatcgctagcttcagattcatcaaacgctccatcccgataagtacgtttctggtttacgaggcaaagaccgtccttataagaaaaccaagcctcatcaaccgtgtaacgttttccctcttcagcacctttgcggaaatagcgcggttccagtttttcaccgatcacacaagtcagcgtatcgcgcatcttgaaaaagaagtctgcccgtttactgcccaaagcaagcagattgatccggtaggctggctgcgcatgataagtggtcacattcgttgtcagactggcgagtccggctttcacccagacaaacttccagttaaaatataaatcatacattacgtgttcgccggattgaaacgcatcattcttcgcttcacattgagcactggctgggagggcgaaagctcccatcagtaaggccactaatccgataataaaattgcgtcgaacgctaacgacggcggttctgactatttcgttcccgatcctttttcttcttgtcttcatctggtttttgttttttaagttcatccagcttttgcttatccagcggaactgcatgaatatcccaactttgttctagatcccagttggctttcggctctaaaatctgattataataatacacctcttcgggctgcacccctttttcaaaattgccggtatcccattcaccgtttccattccggtcgttaatcaaccgggcggagtacttaccgggatttaagtaataaaagtcggcataacctccttcctctactcttcttcggcgtaccactttatcctgcgcatccaacagttcaacgaaagcattaggttccgctcccgtcaccacaaacgtgattttggcatattcttccaaactacgcaccttgaacccttgttttattttgtctgtaaacaatccgtatataccatgaaatgcggtcgaatccaccgaaaattcatattccagcgtcggttcccaatcataatacacattaaacttcttcagatttacggaatcctgctcaaattcaaacggtatatccttccagagcgtatccaccttttgccgcagatgtatggcggcagtgtcgtagctggctatcggttcttcaaaattcaaagaaatatatccatatacatccattgacgaaggggcactaacattcaccggcaagaatttcgtcggttcgggttcatcctcttcccctttctttttcttctttttctttttgtccttatccgactcctctttcttatatttctgcttcgaaacaagattcagcgtatctgtacggggtactaattggtttaaagtatctgtataaagataagtcagactcatggcaagagtatcctgtttgaagagcaaagaatctttcacccaataatggattgtatcgttccgctgattcttttcgatgacaaaagcatccttttcatcgaagtttaagcctttcaagactggcaaagtgtccgccttaccggcaaaataaaaagtgaacttatgaggaaccagtctttccgacttgataagatattgcgaataattaagctctttaaaggcacggaggatgacatcatccggcaaataatgcatatatttcttctcaacaatcgtgtcgtaggtcaatgagtccacccaagcagtatccatgcggatacgttcttccatgcgggggataatcaacgaatcatggaaagcgatcatctcgctcttctgattaaaagtaaagttttggtcggcatccatcaatccatagatgcgatatttgccgggagctacaccacggatggagaaacgtccacggctgtctgtacgtgccacacggtcgaaaggcaatttgttgaaagccgaatcattcaggttggaatgtagtccgacaagcatacctttaataggttccaggttagaggcgtcgagcattgttcctgctacttccatcgtatcgatttccgtaccggtagaaaatgtaaatgcaaaattccctagcgggttaccttcattattgtcgacaattgcatccgagaagtcaatcgtataggtcgtgttaggcttcaaagagtcgagtaggttgacttgtattctcttgccggaagccttgatttccggttgctgtatctggggaggagaaacaacgactttttcggttgctttctccagcttaataaactcatcaaacatcaaagaaattttagtcctttcattattcagagcgcccgcagcaggagtactaccgatgaaacggggcggcgtctcatcataagggcctccgtccggccgtccaatactggcgcaggaatataacatagctcccagcgttactaccggaagcaccttgcgaactatttgctttatcttttgattctcaaattgtaacatgctgcaaaaataagggttcttattcaataaacaccacactttctagctaatttattaaaaaaggaaagggtgacttaaggtaataaacaatatttgcgacgtttttatttctttcctgctaatataattagttttattgcctaaagagattacctttgttgcctaatcttttttcgttccactatagtgttccgcaaagaacactatagtttcccttgcggagcactatagtgggacgaaagagaaactatagtggaacgaaataaaagtagcaagtgaagtaaatccggataggcaaacggatttatcaatgtgcctacactaaataaaaacgaatatgagtatacaatatgacctttacgacacgcctgacattcaacaaacaggcgacgcacaaccgcttcatccccgcgtagtattcaaaggaaccgtcgatcaggaagaatttctagaccgtgtacacaaattcacaggaataagtcgcagtttactggcaggtgctatgcagtctttccaaaacgagttgagagacctgattgccaacggatggattgtggaactgggagatatcggatatttttcagtgtctttgaagggacctcgtgtaatgaagaaaaaagatgtacacgcacaatccatagaactgaagaatgtcaatttccgggtaagtagccagtttaagaaagaagtaggccagcaaatgagactggaacgtggagaatcgatgactcgtcaccacgggaaagggcgcagtgaagaagaatgtttgacaataatcaaccagcatctgaacaaatatccctgcctgacccgcaccgactatagccgattgacaggacacgacaaaaaacgtgctttgaaagaactgaatgcttttatcgaacgtggactcttaatccgttatggaacaggcaaacaggtggtttatgcaaagaaaacagaaagttaagttaaaatcatctagcagaattacctagaattccaattctgaactgaacaaaaaaaaacaataattcagtgtagggttctttttatattaatcatatttatactgacttttagtaaatcagaactatctatgaaattataaaacaagattacttgctttatcaatatttattgctacttttgtagcggtttcctttcatacgtagagaggaacattttattttttatagagaacgattatttattgcattcaaccataaattcggcaaaaatttaccgcgaatggcaataagtgatgtcaggtctcgcgcacacttctgtatataatttgtttatatacccaatgggcgtgggactatcacttatgtcgcggagggtctttgccgagcctatggttggcgtacagttggtagtttcccacgctctctttttttaaaccgcgcaccacagggaaatgatgcgacaaacataacaaagatatgtacgacgacctgaaagaaaacattattctagtaatgcagcaccctatcgcgcgccgccccatctccaacttatcagatgaagaacgagaaaaagcatttgacttgttgaactatctttcaactttatccgttgacgaaaactataccttgttagattacatccaaatggcacgtcttgaatatgcacttggagagcttgagtataaaacaaccaatgatacagaaaaagtaatacgacattttagaaccgccctccaacatctggagaaaggagggttcgacttaagtataagcaagtggacagagttagtcagcctgcgaaccaaagaagacacggaataattcagaatcataacccttaccaatatatatagaagatagaaaacaaagcgaaaaagattgcttgtgcaagtagtcctttcgttctatcttcgaagaggatgccttccccacacttgatactccaatatcttgatcggcatcctcttcttctatctttctgccaaatcttttttacataaaacaccccaatacagcagcattctacttattaactaatttattaacgcacaattctttttcagcttggtcatgaatttcggaaaccatatctttgcatcgtgatcacaaaacaacaataaaacagattaactaactattaaaaaaagaaagactatggcattaaagtatgttgtcaagaaaagagttttcggctttgacaaaacaaagactgaaaagtatgtagcacagaatgtaattaccaatacggtaaatttcagagatttatgcaaggaagtatccatgttcggtatgattcccgaaggcgcagtgaaacacgtgattgacgcactgattgatgcgttgaatacgaacctaaacaaaggattgtctgtgcaattaggtgacttcggatgtttccgtccgggcatgaactgtaaaagtcagaatgaagaaaaagatgtagatgccgataccgttcgacgagtgaaaatcgtatttactccgggatataaatttaaggatatgctggataatgtaagtatctacaagacggaaggaaacagcggcacctcttccggaaatggagggggaaataaaccggaaaatccggacgaaggcggtagcggtgaggccccggatcctgcagcataaaactcgaacaagggaccacacatagaaaagggcttcttcccataaaaatgaaccctaaaagttagacaaaaacttttagggttcgcttagtcatagttaccagcctgtattttgacctaaattaggattcttataatattcagtctgtggtataggatataagtacatcttatcatcccagttacgtgtttcaagcaattctttcttataaacaggcaagccgttttccatagtgatcttgatgcaataaatagctttggttttatcaccgattttccaacggcggatatcccagaacctatggtcttcgaacgcaagttccactcgtctttcacgacggacgctttcagtaaacgcgtcgccgcttgttgtaatggcaggcatatcagcagcagcacgcacctgattcagtgccgcacgtgcagacaacggatggtcattatccgtataatcagcgtctttccaggcatccattgcttccgcatagttcaggagaatttccgcataacggaatatgatgaaatggtgcggtttctttttctcattggaaggagctagagaaacagtctcattcatatacttcttcaaataataacctgtggtagtcgctccggttgttccggcaccgtcttttcctccttcataagactggatggtcgagttcatccatgtatcgccattgcaaagcaccgttttatagaatctcgggtctctgccttcatacggattctgccccggtgtaatctgttcccagtcaaagtcttttccattagtcatctggaaggcatccaccaggttctgggtgggcacgttgcctgttttccccttttcataactgatgggcaaattgttagcttcaaaatcaaagctttccccatttctacgttcaaaaattaattgcggagatttcaatacatcgtttccaccattcttgtcatacagaggatctacattcgtcttcggcaaactgtaccagttctcttttatgatagcataagccgcatcggcagccgctttccatttatcggcatcctgtgcgggattatgcaacaaactcgccgcataaagaagagcacgggatttcaatgccaacgctgtacctttggtcacacgtcccgtctccgcccaaaagtcctgatgactgacaggcagagttttggccgcgtcactacattcgtcacagatatattttatcacttcattgaaagaagtcttttccacgccgttgatttcatccaaagcatacgtacgtgtcaaaagtggaatatcaccgtatcgtttagccagttcgaacagataaaaagctcgcaacacccgtaattcttcacgatacatggtagctttggcaatgtcttcttcatacgtgtcgttccagcggaaacgctccagtttttcctgtgaatagttttcaaggaatgaattgacggaacggatagctccatagcacttcgaccacatattatcgactgcattgttgggactccaggcattgttataaaagtcgtgaacactattatcactccagacataaacagaattatccgttgcagactccctcaaagccccgtcgagcactccgagatctccgggcaactggctataaacgtaggtagccaaacctttcacattgctaaagtaggaataggcctcttccctgtccaagcctgtcgattcgtccaattcgagcaagctacaccccgatacggataatagcaaacctgtatataataggatatattttctcatggtcatctcacattttagaagttaatattcaacccgaaataaacagaagtcatatccggataattgattttcagatcttcactgttcatatacttcacatgatcgagcgaaaaaagattgttagctctcgcatatacctgaatcttttccattttcactttcttcgcccaagaggaaggaagattatagtagacattcaggttacgaagtttgaaatagctcccgttctccaaccactgtgtactgtttctgaagttattggcattatccaacgtggtcaggcgggggacatttgcgatgtctttcgtttcttccgtccagcggattctgtcattcagataccagttggaaatattcgtgttgtttctcaacggccagtatacgctggcagtgttcaacatcacactataatgggctactccttgaaacagagcatccacgccgaaacctttatattcaaatcccaaattaatgccataataaatctccggtatggcagtggaatatcctatcgccttctggtcattgttgtcaatcacgttatcgccattcagatccctgtacttgacatcacctggacgtacttccgagaatttctgcaccggactgctctttatgtccgcctcatctctgaaataaccgatagcctcccagccaaaacactgcccgacagggtaaccttttttagacaaatagccatacggctgatatccctcaccattttctacgactttacttttggcataggagaagttggctccgatataatagttgaagtccttgtattcctttttccacatggcagagagttccgttccttttgtttccacctttcctgcattcatctgcggaatagtaaccccgattgccgatgagatcagcccacttccgtcaatcaggatattagtacgcttgtcataaaaaccgtcaatagaaaaagtcagtcccttgaacaggctcatatccaaaccgatattatatttatccgcaacttccagatccagttgttccattgccaacactccttccttcaggctacttccggcagaagtatttccggcctgaaaatagtaagcaccgcttcctacccaatattgcttatccatgtcataatcataaatatcatatccggagcgtccgtaagaagcacgaagtttcagataatcaaaagcggaaatttctttcatgaaattctcgttcgaaagtatccaggcggcagaaatggcgggatatgcacgatacttgtcgttcttccccaatacgctgctgccaaaacagttggctacgatatccaccatataacggttgtcaaaattataacctgcggttccgatgatgtattgatggtaacgactgttattagcccctgtcaacgtcattgattcttgacgaaacatagcactggccgtaaaatcatgtttatcccatgtccggtgataattgaccttcgcttcaaaattggcatgtatgtattgattggccaatcctttgttgctgatttccagttcatcgttaggatttccgtaattcgtgtaaatcggttctccatctgtgcctttttcaatggtctggtacataaaacttttcttggctgtttcctgataggtcgcattattatcataagcaatagcgagttccgcactcaacccgcgagtcaatacagacaaatcctgcaccaaccgcaaatccgcctgcaacatacgctgattcagtttataataacctacgtccgccagattggctatcgggtttgttttcagcacattgttactgccccagaatccattcagtgtctgcacgggaaatgcggcggacggggtgttgaaaatctgttcaaacaaagtagcttccgatgtggtgggacgcttggtctctcgcagcataccgagcatactcaatttcaattttgtcgcatccgtaatatccacatccagattcatgcgaagattgaggaagtatttcttcatctgggagttatagcgatctgtataatcagtgtacttgctattcagcagtcccatatcgtttttgtaattgaggacactgaaataacgaagccgcttgccacctccgcggaaagtgatgtccagttgatgactggtcgtatgattgcgtaacgcttctttctgccagtccacattcggataaagatcgctattgcctccggacaggaaagaagcttcatccatgtccggttgcaagccatcatatctcaatgcttcattacgggctttggcataggtataagcatcggcaaattccggctgattaacagggaagcctaaaccaaacttgtagtctacttttatatccttctggctatatataccgcgtttggtagttatcaataccactccgttggcgcctctgcctccccaaagagcagtagcagcaccgtctttcaaaacggatattgattctatttccgaaaggttaatatattcgagagggcgtgcaaaaccatctactacaaataaaggtgtatctccattcaaagaaccgcgtccccgcacattgagacgagatttatctgtgccccaactagtgttctgcatcacactcaatcccggcaacaggccataaatggcattgtaaggactagtggtagcatttttatctaattcatccgaataaatggtagagacagcctgtgtcttccgtaattcggtggtcgtctgtgtgcccagatcgattaccttatcttgtccttcattattttgcgctatacccgtagtggcaaacgccaacgagaaagctacgatataaagtgatttattcataatcattcttcttattgttcaacgatttgattattaccaacccggattctgaatcaatccatatttcttgtttatctcatctataggcagaggcaacaggaaatacttgtcgttccacttttcaggttttgcatactgacgcgtttccgccattgcatgagatacggcataagaaaagccgcttggctcaccggccgcttttttaataatcagacgtgacaattgtccggtaaatatatctgcgcgtttccaacgcaccagatcgaaatagcgtacttcttcatagccgaattcaatggctctttcgcgtaatattgcttcacgcaacggtttgccggccggaacatctgttgccgaaatcgcaggcatacccgcacgcagtctggttttattcagataatcataagccgtattgccaaactcatcacggacttccgccttattcaattcgttcatcgcttcggccatattcaaataaacctccggaaggcggatcaacggacaagaataaaatttaccattcacttcgtcattgaagttccgtatgaattttctcatggcaaccccattgtaactcattcgtccgtctttataaggcgcctgggtggctccttcataaatctgcactttctgggcgcccttaaacttatctccattcacagcaaccgtttcatataagcggatgtctcttctggggtttccgtccttatcaaagaaagggaatttattatggtccggattgttccagtcgaattctgttccgtctttcatctgaaacatatcgacataagtcaatgtaggagaagcaactccataacgcacctgggcaaacggaagctttcccgtagcataagtggtgaatcttctggaagaaatcaagacttcaccgttatggcgattgaaatatcctgctgcaaaatcatcgcggggattacctgtattcaccagttgataagcgtccgagttctttttattagcccgcataaattctaatccggcatccaacgccttctgccacctgtctggtgaatagttaccataccaagtaaggaattgagacgaagcatctccttccagatagggtttttcagcattaaataaaggactcgccacaaactgaagcaccctggactttaacgctaaagcagaagcagccgtcattcgtccgtcattatctgcattcacctgccaaggcagtacagaggctgccgcatccagtaatccaacaatcttctgtacggtttcttccactgtcatacgaggaaatttcatcgcatcttctgccgtatatgcatggtctatccacggcataccaccataataacggagcatttgagaataatgataggcaatgattacttgcgcttccgcttttcctatcgctttctcatccgcagtcatatccggcactctatccacattctcaatgtaaatgtaggctcttcgaataccataaaccggccctactcctatcgtagcactggcgacatccaaccgatatggaagatgttccagatatgtatttgttccgtccactgttcctgtatagaatttaggcgctccctttttcgtccagtcacccagatcggttagcatttccagaacgccatatcccagacgtccttgcatcggcagataatccggcagggaatgataagtttccgccagtgcctgctcagcatatacctttttgttaaaaacagaatcgatattctgttcgttacttatcggcttatccagaaatttctctccaaatttaaggtcttcgcaccctatcagtgtcaatacagagagagaaagacagcctatatattttttatagtttttcattgtcagcactattaaaaggttagattaatacctaaattatatattttaatgatagggtaagaatccgcattattcggattacattcagggtccatgatgtcaaacttatcaaaagtcagcagattatagcctgtcagttttatacctaactgctggatacccagtttcttcaacatcttcttatctgtgaagttatatcctattgtcacattcttcagcttcaaataagaaccgtctcgcacccacaaagaggaggaacgcatattatagactgcatttgtctctgtaaaccgcggtgtagtagctgtattagccgtttccggtgtccagcgcgtatctgcatggaactgcatcaaaccacggattttaccattaccaaaaggttctctgaaagctccgtccagcaacaaagagcgttgtgcagcaccagtccagttcatcgtcaggaaaaagcctttgtaattgataccataattcaatccgaatgtataagccggacgagtcgggtttccaatgatagtctggtcgtcggaagtaatttcctcatcaccgttcaaatcccggtatttcacatcacccggcttcacggacacacccggatcgggcagacctgccaccagtttgccgttctctccgaagtccgcttctgtatagaaaccgtccgccacatacccgaagagtgtcccgaccggatttcctgtccgccacatataaggttcattaggctcaacttcgtcttggaaaataatcttattctttgaataggaaacgtttgcctgaacattatactgaacctgcccgatcttgtcattccacctcacttctacctcatatccacggtttttcactttacccatatttacagcaggtagaattgatgaagtcaaccccgttaataaaggtactgtcttacgattgatgagaatatccttacgttcttcgaggaaatagtccaaagagattttcagacggctcttcaagaaatgaacgtccaatccatagttctgtttcagcgcagtttcccaagtcacgttcggattgcccagacgcttctccaatgcacccagaattaacgccttgctgttataaccaaagttgaatccatacttattgttattccacccgtctactccgctcagattcacatcataagaatccggcaggaataagaagcggttatttccaagattgtcatttccgaccaagccgacagaagcacggaatttcagataatcaaccaccttctgttttttcatgaaggcctcttccgacaggatataaccgatggaaccggcaggaaacgcaccgaatctcttacccggagcaaaattctcagaaccattataaccgaagttaacttctgccatatagcgggatttgtaatcatacgtcagacggcctacaaaaccgatgtaagcagacggtactcccacccattgagcgggatagtatttcttactctgattgtacaagaacaatcccccgacattatgaaaaccaaacttacggttatatctcaagcttgcttccagataccagtctcgtgcccgcgaggaagtttcctcatattgcaagctcttattttctcctttgatcttataaacaatattcttgttgaaatctggcgaatcataaccaagtgacggatcttccaaagaagattgatagaaaggcataaattgttccacttgccctttacgctttttggtaaaaccataactcgtattataagcaccttttatttccgccgacaatcctttggttatgaagtccaacttctgatttaacagaaggtccagattcatcgtattattaatagcagttgagtaacccgttccataacatttaggcaaagcactgttgcccagatttattttattatcaaaacgttcctcgggggtaactatgagttgtccgtcaattacacccggactactgaacggagttgtctgattaatcagtgtccagatcgaattagtcgcatcattaatcatcggctcattccggttacctacaatgccgccgataccaatcttcagcgtggtagtcttagttacattaaagtctaaattcgcacgataattgtatcttttgtatttataattattatcataccccactccttcaaactgtttcaacagaccattctgatataagaaacctaaagatatgaagtaacgtatatcctttgttcctccggaaatattcaggttatgctgtgtctgcatagatgttttattaagcagatactttctccagtcgatactgggatacataataggttcatcattcaatctgaaccgttcaactgcataattattgaacaccaaatcgttctcggtagcatttggtttgtcatttgttataatctcgtttcttaaagtagcatacgtatagctgtctgccatttcaagcatacgggtgggcatctggataccaactgaagaatttacggaaattttcgctttgccttccttaccacgacgtgtagtcaccaaaattacgccatttgcaccacgcacaccgaacacggcagtagcagaagcgtctttcagaaccgtcacgctctctatttcattcgggtccatttgataaaacgaacgttctataccatccaccaaaatcaaaggagaggaagcactttctgtcaaggaccccactccgcgaataaacaccttagggtcttcctgtcccggctgaccgctagtctggacggatgagagtcctgtaatctgacccgccagggaattggccacacttgcattcggcgaacgtatcaacgcttcattgtttacagcagaaatagctcctgtcagagtttctttcttttgtgtaccataggccacaactgtaacttcctgaagttcattggccgtttcttttaaaataattttcagttgtttgcgtccatttaatggcacttcttgaggttcatatcccatgaacgaaatttgcagaactgctttttgaagattgcttacttttaaatggaaaacaccattcatgtcagtaatagcaccgttggccgtgcctttttcctttacattggcaccaatcacctctaagttagattcatccaatacagttcccgttactgtattttgcgcccatgccaagagcgaacaacacataagcattaacgtactgatgcacctcttgcatctttttagtctcgtcagtttgttcataataataaatttaagaatttgaaataggtttgttaaaaacactcgccacaaattaagtgattgtaatagtttttaagatacaattatcatactaaaaagggacaaaatagtacaaaataagaaataaaaagcattaaaattagctgtattactcatagtatcaggatgtcacgctagaaaaatacagcctattcatcgtttcttcttgactttaccatactcgagaggtgatactcaaaaagttaatttaccaagttcttctttcaccgtaaatctatgccaactccacataccattaccagactccattgaatagttcataaataaattaaaattgaactattgacatacctattagacttattattctcctttattaatcaaattattccctatctttgactcccgaaattcaaacctaatacaaaaacccatgaagaaacaactactctcttgctgcttggctgcattgggactgacagcaattcaagcacaaagcttcaatgagtggaaagacccggaagtgaattccgtaaaccgctccgctatgcacactaattactttgcttacgcatcggctgatgaagctaaagccggcattaaagaaaattcaacgaatttcatgaccctgaacggtccgtggaaattcaactgggtaagacatgcagatgcacgaccgaccgatttttatcaaactaatttcaacgacaaaggttgggatgaccttcaggtgcctggcgtttgggagttgaacggttacggtgatcctatctatgtcaacgtaggatatgcctggagaagccaattcaaaaacaatcccccgcaagtaccgacagaaaacaatcatgtaggctcttaccggaaagaaatcatccttcctgctgactggaaaggcaaagagatttttgcacatttcggctcggtaacttccaacatgtacctttgggtgaacggacgttacgtaggatatagcgaggacagcaaactggaagccgagttcaacctgaccaactacctgaaaccgggtaaaaacgtgattgctttccaggtattccgctggtgcgacggcagttatctggaagatcaggacttcttccgctactctggcgtaggacgtgactgctatctttacgcacgtgacaagaaatacatccaggatattcgcctcactccagatttggatagccaatataaagacggtacgctgaacatagccgttgatctgaaaggaagcggcacagttgccttggacttgacagatactcaaggtaacagtgtagcaactgccgacctgaaaggctctggcaaattaaacactaccctatccatctccaacccggccaaatggactgccgaaacgcctaatctctacacgctgaccgctacactgaaaaacggcaacaacgtagtagaagtaatccccgttaaagtaggattccgcaagattgagctgaaaggcggacagatactcgtcaacgggcaaccggtactcttcaaaggagccgaccgtcacgaaatggacccggacggcggttatgtcgtttctctcgaacgtatgttgcaggatatcaaagtgatgaaagaattgaatatcaacgctgtacgtacttgtcattatccggacgacaaccgttggtatgacctttgtgaccaatatggtctgtatgtagtggccgaagccaacgtagaatctcacggaatgggttacggcgatcagacactggcaaagaacccgagttacgctaaagctcacatggagcgtaaccaacgcaatgtacaacgcggatacaaccatccgtccatcatcttctggtcactgggcaacgaagccggcatgggaccgaactttgaggaatgctacacttggattaagaacgaagacaagacacgtgccgtacagtatgaacaagcaggaaccagcgaattcaccgatattttctgcccgatgtattatgactacgacgcttgtatcaaatatagcgaaggcgacatccaaaagccgttaatccaatgcgaatacgcacacgctatgggtaattcacagggaggattcaaagaatactgggacatcatccgcaaatatccgaaatatcagggcggatttatctgggactttgtagatcaatcctgccactggaaaaacaaagacggagtaaatatctatggttatggcggtgatttcaacaaatacgacgcttcggacaacaatttcaacgacaacggtttaatcagccccgaccgcgtgcctaatccgcatgcatacgaagtggcttatttctatcaggatatatggactactcctgcagatcttgccaaaggtgagatcaatatcttcaacgaatatttcttccgcgacctctctgcatattatatggaatggcaattactggcaaacggggaagtagtgcaaacaggcatcgtgtccgacctgaaagttgcaccccagcaaactgtgaaagtgcaaattccgttggacgtgaagaatatctgtccttgcaaggaattgttgctgaatgtgagctataaactgaaagccgccgaaacgttgctgccggcaggaacgactatcgcttacgaccagttaagcatccgcgactacaaagcaccggaactgaaactggaaaatcaacaggcttccaacattccggttatcgtgcccagtattttggacaacgaccgcaattacctgattgtgaaaggtgaaaacttctctatggacttcaataagcacaatggttacctttgtcgctacgacgtcaacggcatgcaactgatggaagacggcagcgcactgactcctaacttctggcgtgcaccgaccgacaatgatttcggagccggactgcaacataaatacgctgcctggaagaatcctgaactgaaactgacttctctgaaacatgctattgaaaacgatcaggcagtggttcgtgcagaatatgacatgaagtcgattggcggaacattatcgctgacttacaccattaacaacaagggagcagtgaaagttacccaaaagatgatggcagacaagagtaagaaggtttctgacatgttccgcttcggtatgcaaatgcgaatgcctgtcaacttcaacgaggtagagtactacggtcgtggtccgggagagaactatgctgaccgtaaccacggagccatgttaggcaaataccgccagacggtggaagaacaattctatccttacatccgcccgcaggaaaccggaaccaaaacggatatccgctggtggagacttctgaacattagtggtaacggattgcaattcatatcggatgctcctttctctgcttctgccctgaattataccatcgagtcattggatgacggtgacggtaaagatcaacgtcactcaccggaagtagaaaaggcagacttcaccaatttctgtatcgataaggcacaagcgggacttgcttgtgtgaacagttggggagccattccactggaaaaataccgtcttccttaccaagattatgagttaagttttattatgactcctgtatatcataaaataaagtaaaaaacatagttaaaaaacacggtatcagagaacaagaataccgaatttaaagtacttttgcagccggaaactaatttaaccgaattagtttccggctttttcttccttaacctccttaatctatatggacgaacagcacactggcaacaaatgcattaaattaaaaaacagatatttataagtatgaaaagtagaattgttttatttgcattttgcgtagccctcttgtcaagttgtggcaataagggcaatgacacaggaaaggttcctgaatatgcagtacaagagttacaaaagacgaccgctaatttaacaactgcctatccggctaccatcaaaggtaaacaagatgtagaaatccgcccccaagtatcaggcttcatcacaaaactctgtgtagacgaaggagcagctgtacgtaaaggacaagtgttgttcattgttgatccgactcaatacgaagcagctgtacgcactgccaaagcagcagtggctacagcagaagcagcagtgagcactcaacagatgacgtatgacaataagaaagagttgaacaaaaagcaaatcatcagtgactatgacctggcaatggcagaaaactccctggcacagaccaaagcccagctggcacaagcaaaagcacaactgaccactgctcaacagaacttgtcattcacacaggttaaaagtccgtcagatggcgttatcaacaatatcccttatcgtgtaggagcattggtaagcccttctatcgctacaccgatgactactgtttccgagattgacgaagtatatgtatacttctcaatgacagaaaaggaattgctggcaatgaccaagtccggtagcactatcaaagaagaaatcagcaaaataccgactatcaaactacaattaatcgatggttccacatacgatatagagggtaaagtggatgctatcacaggcgttatcgaccaatctaccggttcggtaagcatccgtgccatcttcccgaataaggaacatgtattgcgtagcggaggtactgcaaacgttctgattccttatgctatggagaatgtaatcactataccgcagtctgcaacagtagaaatccaggataagaagttcgtttatgttctgcaaccggacaacacggtaaaatatacagaaatcaaaatcttcaatctggataacggaaaagactacttggttacttccggtctgaattcaggagataaaatcgtaatcgaaggagtacaaaacctgaaagatggccagaaggttcagcctatcacaccggcgcaaaaagaagcaaactatcaacaacatttgaaagaccaacacgacggtaatttagccacagccttcaactaataatcagataatcattatgaaattagatagatttattaaccgtccggtactatcaaccgttatttctatcctgatagtcatcctgggggctatcggattggcgacactgcctatcacgcagtatccggacatcgcgcctcctaccgtttcggtaagagccacctatacgggagccagtgcatcgaccgtattgaattccgtgattgctccgttggaggaacaaatcaacggtgtagaaaacatgatgtatatgacctcaactgcgtcaaacacgggttccggtgatatatccatatatttcaaacaaggaacagatccggacatggccgccgtcaatgtacaaaaccgtgtctctatggcacaaggtctgctgcctgccgaagtaactaaagtcggtgtaaccactcaaaaacgccagacttccatgttggtagtattctctctttatgacgagacggatacctatagcgaatcgtttattgaaaactatgctaagatcaacctgattcctcaagttcaacgtgtacagggtgtaggtgatgccaacgttttaggtcaggattattctatgcgtatctggttacgaccggatgtcatggcacaatacaagctcgttcccggtgatgtttccgctgctctggcagaacagaatgtcgaagctgctccaggacagttcggtgaacgcagtgaccagactttccaatataccatccgttataaaggacgcttgcaacagcctgaagagtttgaaaatatcgttatcaaatctcttcctgacggtgaagtactccgtctgaaagatatagcagaaattcagctggaccgtttgggatataactttaccaatcgggtagacggtcacaaatctgtgacttgtatcgtataccagatggcaggaaccaatgcgacacaaaccatcagtgatattgaggcattgttggatgaagcatcaaaaacgttgcctaccggattgaaactgaacatctccatgaatgccaatgacttccttttcgcttctatccatgaagtggtgaagacgttgatcgaagcatttatcctggtgtttatcgtagtgtatatcttcttgcaggatttacgttccacattgattccgactatcgccattccggtagctctgatcggtactttcttcatcctgtccctggtaggattcagtctgaacttgttgacgttatgtgcgctcgtgcttgctattgcgattgtggtcgatgatgcgattgtggtcgtcgagggtgtgcatgccaagcttgaccaaggttatacatctgcccgtctggcttctatcgatgccatgaatgaattgggtggtgctatcgtatctattacgctggttatgatggccgtattcgttccggtaagtttcatgggaggtacagcaggaacattctatcgtcagttcggtatgactatggctatcgctatcggtctgtccgcattgaacgcattgactttgagtccggctttgtgcgccgttcttctgaaacctcacaaaaaagaagatggaacaacggaagactccacattgaaagaacgtatgaaagtagcctatacggcagcccatacaactatgatcaacagatataccgaagctatcggaaagatgttgcatccgggaattacacttactttgacgcttattgccattctcggcatgatctttggtttgttcagtatcaatccgatagtcactgcaattttcgtagtgcttagtattctggcactgatcggaatgagtacgaagaagtttaaaaacagattcaacgatacatacgaatcaatcctgaaacgttataagaaacgagtactgttctttatccagaagaaatggttgtctatgggattagttgtcgcttccattgcgatacttgtattcttcatgaacaccactccgacaggtatggtgcctaatgaagataccggaacgctgatgggagcagtgacattacctccgggtacttcccaagaccgttctgaaaaaatcctggcacgtgtagacagtctgatcgcttccgatcctgcggtattgtcacgtaccatgatttccggattcagctttatcggtggccagggaccatcatacggttctttcatcatcaaactgaaagactgggacgaacgttccatgatacagaattcagacgttgtagtcggttccttatatatgcgtgcacaaaagattatcaaagaagcacaggtattgttcttcgctcctcctatgatcccgggttactcggcatctacggatattgaggtcaatatgcaagataagaccggtggtgatctgaacaaattcttcgatgtggttaatgattatacggcagcattggaagcacgtccggaaattaattcagcaaagacttccttcaacccgaatttcccgcaatacatgattgacattgatgcggcagcttgtaaaaaagctggcatcagcccgagcgatatcctcactactatgcaaggatattacggaggtttgtacgcatccaacttcaatcgtttcggtaagatgtatcgtgttatgattcagtcagatccgttatcacgcaaaaacctggaatctttaaaaaatatcaaggtgcgtaatagtgcaggcgagatggccccgattgcccagttcatttctgtggagaaagtatatggtccggatattattagtcgtttcaacctttatacctctatgaaagtaatggtagctccggcaagtggttatacatccggtcaggcattgacggctcttgccgaagttgctcaagaaaacctgcctaccggttatacgtatgaactaggaggtatggcgcgtgaagaggctcaaagtagcggaagtgctaccggactgatttttgtactctgttttgtattcgtttacttattgttgagtgcacagtacgaaagttacattcttccattggccgtattattatccattccgttcggtctattaggcagtttcctgtttgtgaatggtgtaagtgctatcggtaatatttcggcattgaagatgattctgggtacgatgtcaaacaatatctatatgcagatcgcgttaatcatgttgatgggtctgttggcgaagaatgccatcttgatcgtagagttcgccctagatcgtcgcaagatgggtatgagtatcacttgggcagctgtattgggtgccggtgctcgtctccgcccgattctgatgacatcattggcgatggtagtcggtttgcttccgttgatgtttgccttcggtgtaggtgcccacggtaaccgtacactaggtactgcctctatcggtggtatgttaatcggtatgatttgccaaattttcatcgttcctgccttgtttgttatcttccagtatctgcaagagaaagttaaaccgatggaatgggaagatattgacaatgcagatgccgtaacagagattgaacaatacgctaaataatgaaattcgatatgaagaaacagattctatatatgttgtgcgcaactgctctcttgagcagctgccacatctataagtcgtatgacagacccgaagatatcactacttccggcctgtatcgcgatccggtagcggataatgatacactggtttcggatacagccaacttcggtaatctgccgtggagagaagtcttcaccgacccgcaactccagtcactcatcgaaacgggactgaaacaaaatactgacctgcagagtgcaatactatcaatcaaagcagcccaggctccgttgttggcagccaaactagcctatgttccagctctggccttgtccccacaaggtactatcagcagttttgataatagtaaagcaagtaagacttattcacttccggtaaccgccagttgggagattagtctctttggaggcttgctaaatgccaaacgaggtgcagatgttgccgttaagcaggccaaagcttacaaacaagctgtacaaacgcagattattgccaatgttgctaatctgtattacactttattaatgcttgaccgccaactggaaatcaccagagagacagcagaaatattaaagcgtaatgccgaaacaatggaagcaatgaaaaatgctgctatgtataatatcaattcggcaggtgtcgaacagagtaaagcggcttatgcacaagtgatggcctctattccggatatagaacagagcatccgcgaagtggaaaattctctatcaactcttcttggagaagctccccgccatatccaacgcggtaccatcgaaaagcaaattctaccatccgaattttcagtaggcatacctatccaattattatccaaccgtccggatgtaaaagcggctgaaatgtcactagcttctgcttattataacacgaactccgcacgttccgctttctatccacaaattacacttagtggatctgccggatggacaaacagcgcaggctctgctatcattaatccgggaaaattcctggctactgccatcggctcactgacacagcctctcttttatcacggagcaaatatcgctaaactgaaaatggccaaagcgcaggaagaacaggcgaaactctccttccagcaaacgctgttgaatgccggtagtgaagtcagcaatgcgctaagtttataccaaaagacgagtgaaaaggtagaatctcgtcaaatgcaagtagaatctgccaaaaaagcttcggaagatacaaaagaattgtttaacttagggacttcaacctacctggaagtattgtctgcacagcaggcttacttgagcgcacaaatctcacaggtttccgattgctttgatcggatgcaggctgtagtaagcctttaccaggcactgggtggtggaagagaagaataactttaaacatatactattatgattagtccgttagcttacgtagatcccgaagcaaagctgggcaagaatgtaaccgttctgccttttgcctacattgaaaagaatgtagagatcggggatgactgcgtcatcatgtcttacgctagtatcctgcaaggtactaaaatgggaaaaggaaacaaggtacatcagaatgctgtcctcggagcggaaccacaagatttccactatactggagaagaaagcagcctgattatcggagataataacgatattcgtgagaatgtagtaatcagccgcgctacatttgccggcaatgctaccaaaatcggaaacggaaactacctgatggataaagtacatctttgccatgacgtacaaatcaacaataactgtgtggtaggtatcggcaccactattgcaggagaatgtacgttggatgattgcgctatcctaagtggaaatgtcactttacatcaatattgtcacatcggaagctggacactggtacaaagcggctgccgtatatctaaagatgtacctccatacgttatcatgtcaggaaatccggtaacatatcatggtgtaaacgctgtagttctttctcaacatcacaatacatcggaaagaatccttcgtcacatcgctaacgcataccgtttgatttatcagggtaatttcagcgttcaggatgccgtacagaagattatcgaccaggttcctatgagtgaagaaatcgagaatattgtaaatttcgtgaagaactcggaaagagggattgtgaaataaacaatataacatctataaaaagaaagggtgatgctcaaaaaaagcgtcacccttcttttttatagatggatgacgcaatagataatatttttacaaatggaggatacttcagtgattcagcaacactagtgattcatcttcaaatccagaaattcaattcatcattcaaattccaaagtaccgaaaaaatcggggcgatggaaatccggttggtcaatctctatcggattccatgaaagaaaatgaggagtctgcaactcatcaccacacttatagaaattagcttttatctcctttccatcgagtgattcaatctgatgcttaaagaatacagcatacggaatgatgagagcaacttcccagtctgtctcctcgacacgttctgcaaaaggctgattacccagactagaccaacgttgtacgagagcagtcacttctttcggtgcatgttcccggttgttacgaactgggccggcacctatcaggatagttccgatgcaattacattctatattataatagatcccgtcgcctgcaggtatagaaaagaattccacacaagagtcagtccatacagaaccgttatcttctccatacttggcacgtacactctcctctttcactttaaaatgtagcaagattgagttctgcgtgtgagcaattcgaaaactcactttaggtttgtaaggatattcagcccaattgacacactggatcggctgaaaatctattttttcttcatcgaatagtttaggaagcgaacaagcctccacgttagccgcactaattttctttactttcatatatctttcgtttgaatgatacaaatatagttactttcttctaataaggttcactgaaatcgaataaaaacaatatatttgcatagatgtaaacaccttaaaaaataaattagtgagaaaagtaattcttttatttctgctatttttaagcgtagctggagtccgcacacaaggtcaaaacatcacttttagccacttgaccacggacgacggactctcccaattttctgtcaatagcctttatattgatgaacgggggattatatggattggcacgcgtgaaggactgaaccggtataacggtaacgatatcaaaagtttcaaacttaataaaaacgatccgaacagtttgttcagcaatacagtgctgcgtatcaccggaaacaaaaacgggaaggtatacctgctctgtacggacggggtagcagagttcgatctgaccacacaaagattcaaaacgttgctgcaaggcaatgtggatgctatttatttcaacgagaaattatatatcgggaaaagagaagaagtgtttgtatataatgaaagtaccggaaacttcgatctctactatcatcttgccggaaaagatatcaccctctcctgcctccacctggacgaaaagaaaaatctgtggatgggaactaccagtaacggactttactgtttatcgggagacaagaagatttcccaacctgtcacaagaggtaatatcgcgagtatttacgaagattcgtctaaagaattatggatctgtacctgggaagaaggactctaccggataaaaacagatagtaccattgagaacttccgtcatgatcctaaaaatccaaacagtatttgcaccgacttcgtaaggagttgctgtgaagataatgcaggaaatctgtggataggaacctttcacgggttaaatcgctatgaaaagagcacaggtaaattccaactttacactgccaacgcgaacaaacccgacggacttacccactcctccatctggtgcatcgtcaaagatgaacaaggaacaatttggctgggtacttatttcggaggtgtcaactatttcaatccagaatatgaaatctatacccgttacaaaaccggagatacagagaaagaaggtctaagtagtccgatcgtcggtagaatgactgaagataaggacggaaacctgtggatttgtaccgaaggcggcggcgtgaatgtgtataaccggaaggataacacctatcggtggtatcgccacgaagagggcaaaaatagcatttcccataacaatgtcaaagcaatctactacgaccggactaatgaaatcatgtggataggtacacacttgggaggattgaacaaactcgacctgcgtactaaccgtttcacagtctaccgaatgaaagccggagacccaacctcactaccttcggatatcgtccgagacattgtaccttataaggacaagctggttgtcgccacacaaaacggtgtttgtcttttcaatccggcaacaggcgcttgccaacagctcttcaaagagactaaagaaggaagaggtattggcatggtagccagtctttgcattgataaagacggtacattgtggattgcggctaccggggagggtgtttattcttaccggttcgacagcggtaaacttactaattatccacacaatcccgctaatccgaacagtcttagcaacaataatatcaacagtatcatgcaggacagtaacggtaatctgtggttctgcacctccggaagcggtctcgaccgttaccgtaaggcaagtgatgactttgaaaacttcgatgtacagacagatggtttatccagcgactgtatctacgaagtatgcgaatcgtccatacagaaaggagacttattgctgattaccaatcagggattctcacagttcaactatccaagcaagaaattctataattacggtacggagaatggattcccgttgactgccgtcaatgaaaacgcactatttgtgacacatgacggagaagtattccttggcggtattcagggaatgatttctttctgggagaaaaaattacatttcactcccaaatcatataatatcattctttcccgcctgtttgtcaacggaaaagaagtagttccgggagatgaaagcggcatcctggaacagtcgatctgtcatactccggaaatcagtctgaaagcgaatcaatcgatgtttagcatcgaatatgccacttccaacttcatccctgccaacagagatgaaattctctatcgcctggagggtttctcagacgaatggaaccatacttaccggaagcaaacgctgattacttatacaaacctgaatccgggtaaatatacccttgtcatcaaatcacagagggaaggaataaaagaggccagactgctgattatcgtactcccttcatggtatgagacatggtgggcttacctgatttataccattgtcactatcagcctgttatggtatcttattcagaactataattcgcgcatcaaactccgtgagtctttgaagtacgaaaagaagcatattgaagacctcgaagcattgaaccagtcgaaactccgtttcttcactaacatctcgcacgaattccgcacaccgttaacgctgatcgtgggacaagtggaaactttgttgcaggtgcagacatttacgcctaacatatataataaggtattgggaatctacaagaacagtctccaattacgggaactgattacggaactacttgatttccgtaaacaggaacagggtcacatgaagatcaaagttagccagcacaatctggttaacttcctgtatgagaattatctgctcttcctcgaatatgcgagcagtaaacaaatcaacttcaagttcaacaaacagaaggatgacattgaagtatggtatgaccaaaagcagatgcagaaagtgataaacaacctgctgtctaatgcagtgaagcataccaaggccgaagatacaatttcgattaatgtatcgcaggagaaagaccatgtcatcattgaaataaaagataccgggacaggtatcgccgctgccgaaattgataagatattcgaccgtttctatcagaccgaacatctcaactcgctgaataccggagccggtacaggcatcggactggcactgacaaaaggtattgtggaacttcatcacggcacaatccgggtagaaagcgaaccgggcaaaggaagcagtttcattatcaccctcaaactaggcaaggaacacttcacagaagagcaaatagcgaaagatgatacggaaaccatccagcaaacagagactattgttccttcagtagaaataatccctgattcggaatggaaagaagaagataacaagcgcatcgaagacgccaaaatgctgatagtggaagacaatgaatctatcaagcagatgttagtcggtattttcgaaacattctatcaagttagtacggcttccgacggagtagaagcattagagatgatacagaaggatatgccgagcatcattttaagtgatgtcgtaatgccacgcatgtcgggtacggaactttgcaaacagatcaagacggactttaacacttgccatattccggtggtattattaaccgcacgtactgctatagagcacaatatcgaaggtttgaagattggtgcggatgattatatcactaaaccgtttaataccaatcttctgatttcccgctgcaataacctggttaattcccgccggctattgcaagagaagttcagcaaacaaccacaggcttttgcccaaatgttggctaccaacccgatggataaggagatgctcgaccgcgcgatggccattatcgaacgtcatctggacaatacggatttcaacgttaatatcttcgcccgcgaaatgggtatggcacgtacgaacctattcactaaactgaaagcagttacaggccagaccccgaatgatttcatcttaagcatacgtctcaaaaaaggcgctgtcatgttaaggaataacccggagctgaatatcacggagatctctgaccggattgggttctcctcctcccgctatttcagtaaatgtttcaaggagatttatcacgtcagtccgctggcttatcgtaaaggagaagagagcgaagaagaaggagacggagaagaagcagattagcaggcaactatacaagcactcttgcaaaataatcttatattattaggcacggatcacacggatttcacggattaaaaaacgatgagtatgaaaacaacagcgttaatccgtgtaatccgtgcctaaatttatgatataaacggtttcttaatccggacatcttcgcccgaataaagaaggtaacttcttaagtgtactattttgtacttcacttgtacattcctactcattctttttgttccattcgcttatctttgtgttcattacattatttcctaaaacattcagcattatgaaaaacgtttcgcgtctacttcccctattgtccggcatcgtcacgctgtcaggatgcaatcatgcaccccaaaagagcaatgggcagaatagccaaaagcctaacattatttatatatttgcagatgatctcggcattggtgatttaagttgttatggagcaacaaaagtgagcactcccaacatcgaccgattggcaggacaaggagtacaattcaccaatgcttatgcaacttctgccaccagcaccccttcccgtttcggactcctgacaggcatgtatccctggagacaggaaaacacaggaatcgctcccggcaactctgaactcattatcgacactacctgcatcaccatggcagatatgctgaaagatgcaggatacgcaaccggtgcagtaggcaaatggcatctgggactcggtccgaaaggtggaaccgactttaacaaccggattacccctaatgcacaaagcatcggttttgactacgaatttattattccggctactgtagaccgtgtaccttgtgtatttgtagaaaacggacatgtcgtaggacttgaccccaatgatcctatcaccgtaagctacgaccacaaagtaggcgactggcctacgggagaagagaatccggagctcgtcactttaaagcccagtcagggacacaacaatacaattatcaacggcattccccgtatcggctggatgaccggaggaaaatccgccctttggaaagatgaagacatagccgatatcatcaccaacaaggccaagaatttcattgcatcccatcaggaagaacctttcttcttatatatgggtacgcaagacgtacatgtaccacgcatcccccacccacgtttcgcaggcaaaagcgggctcggcactcgtggcgacgtcatcctgcaactggactggaccatcggtgaaatcatgcacacactggacagcctccacatcgcagacaacaccatcctgatctttaccagcgataacggtcctgttatcgacgacggctatcaagaccaagcttacgaacttctcaacgggcatactccgatggggatctaccgtggtgggaaatacagtgcttacgaagcggggacacgcgttccatttatcgtccgctggcctgcccgagtaaagccgaacaagcaacaagctcttttctctcaaatagatgtgtatgcatcgctcgcctcccttttggaccaacctttacgtaaaggagctgctcccgatagtcaagaacatctgaacgtactcctcggcaaaaataatacaaaccgtgagtatgtcgttcaacagaatctcaataacacacttgccatcataaaaagtcaatggaaatacatcgaaccgagcgacggccccgctatcgagtattggacgaaaatggagttaggcaacgacaaacagcctcaactttacgatttatcctccgatccatcggagaaaacgaatgtatcaaaacaatatcccgacatagtgaaagaattatctgaattactagaatccgtaaaagaaaaatagtttatgagaacagaaaaattgtatgattttgcaccaatcttgaataattctatccatattagaatattcaatccatctatctttgcaagcgtagattcaataaaatcacttaatttttaatatatgaaaaaacatttatccactcaaactagaaaaaggatgctctcctccatcggactgatcctgttttctgtttcttttgtacttgcacaggtacttgttaaaggtacagtgaaggataacttaggagaaggagtgccgggagccagtgtccaggtaaaaggtacttcgcaaggaacaatcactgaccttgacggtaaatttgcttttaacgtgcccaataaaaattcgatattggttatttctttcattggttatgtcacagtagaaatgaaggtggacactcaaaagccaatggttatcacattaaaggaagacacaaagacattggacgaagtggtagtagtcggctatcaggagatacgcaagaaggatctgactggctctgttgccaaagccagtatggcagaactgcttagcactccgactgcttctttcggcgagacattaggcggacgtattgccggtgtcaacgtaagttcgggcgaaggtatgccgggcggacagatgaacatcgtcatccgtggtaacaactctttgacacaggacaactctcctctttatgtcattgacggtttcccggtggaggacccctccatagccgcagccatcaatcagaatgatatcgagtcactcgacttcctgaaggatgcctctgctactgctatctacggtgcccgtggtgccaacggtgtcgtgatgattacaaccaagaaaggaacaatcggccaacctaaaattaaatatgacggaagtttcggtattcagcatatcaccaaaacaatcccgatgatggatgcctatgaattcgtcaaactacaggcagaacgtagtcccaaagatatggaaactacctacttcatgaattatgacggcaagaaatggggattggaagattatagaaatatcccgcaatataactggcaggatgaaatctttcgcagcgcatggatgcaaagccacaatgtcagcctgaccggtggttcggaaggagttcgttacaacgcttctttatcttattatgaccaggacggtatcttgttggaatcaaactacaagcgtatacaaggccgtatgggtactaccattcaaaagaagaaactgaaaatctatctgacaaccaactattcaagtactacaaccaccggtggttctccttctcagaactcatacagtggtatgaataacctgttctatagtgtatggggatatcgccctgtgacagaaccggacagaccattaaactcgttgatggacaatatcatggacgatgcgataaacaataccaacgactatcgtttcaaccctatcatgtctttgaaaaacgaatatcgcaagacgtacgcgaactatatccagttcaacggatttgcagaatatgaatttatcaaaggattgaagttgaaagtttccggcggttacacgttcgatacccgcaaaggggaaacattcaacaactcgaagacccgctatggtaatccgaaatcatccgataaggtaaatgcagaaatctaccattctcaacgtgcaacatggttgaacgaaaatattctaacctatcagaccaatatcaaacggaaacatttcttcaatagcatggtaggtgtaaccctgcagaattccgactatgaatactattcatacaaaacggtacagattccgaacgaagcactcggcatggcgggaatgagtgaaggaactcccagtacgactaaatcattaaagagttcctggtctatgctttctttcctgggccgtttgaactataactataaatcattgtattatgcaacggtttctttccgttccgacggttcttccaaattccgtggtgataaccgtttcggctacttcccttccggttcattggcatggggattcatggaagaagattttatgaaaccattgaagtctgttgtttcttcaggtaaattaagagcaagctggggattgaccggtaacaaccgtgtaggcgagtatgatacgtatgctttatatcagatattaaaagataaagtcggagattttatttcgatcggtagcctaccgagtggtgtatatccgttcgaaaacagcctgacaagtgtaggtacagtgcccacttccttaagaaacagaaaactgaaatgggagaccaccgaacagtggaacctagggctggacttaggcttcctggacgaacgtatcggattaaccgtagactggtatcgtaaaacgactcgtgatttgttgctgaatactgcacttcccacctcttccggttatttcagtgccatgaagaatgtaggaaaggtacgcaatcaaggtatcgagttcacattgaacacgaccaatatcaagaaccgtcatttctcatggactactaactttaatatcgcattcaacaagaacaaagtattagaattggccgaaaaccaatcttctctgttgagtgcagccaaatttgaccagaactataactctcaatacagctacattgccaaagtgggttatccgatgggaatgatgtacggattcatctacgaaggtacatacaaatacgaagatttcgacaaagtaggtgatacatatacactgaaacgcaatgttccgtatttctcttccgaaagtaatacacaaccgggtatgccgaaatacgcagacctgaatggtgacggtatcatcgacgataacgaccgcactatgatcggtaacggtatgccgaaacatacgggcggatttaccaacaatttcgaatacaaaggatttgacttgagcatcttcttccaatggtcgtatggaaacgatgtattgaatgccaaccgcctgttcttcgagaacagcaataaaacacgtgacttgaaccaatacgcaagttacgcagaccgctggacaccggaaaatccggaaagtaatattccgagagctaccgactccggttctaacaaagtgttctctacacgtattatcgaagatggttcgttccttcgtctgaagaccgtatctttaggatatacactgccgaaacaactgaccaaaaaatggaagatagacaatgcacgcgtattcgttgccggtcagaatctatggacatgtacagggtattccggttacgacccggaagtatctatccgtgaaggcgcactgactccgggactggacttctccgcttatccgagagcctactctatcagttttggtataaacttaggtttctaatcaatcatccttcaaacaattacgtatatgaaaacaataaaaataatcatcatatcacttcttgtcggacttaacctgacttcctgcgatttcttggaaaaagacccgacatacaccactcctgaaaacttcttcaaaaatgaagcggacgctacctcttggctgacaggaacctatgccattctgggacaaagttccttctacggaaatgagttcttataccttgtaggaggtgacgatctgggacactatggtggtgccaaccgcggacctaataaaagtgggttgatctgtaacaatgccaatacaagtgatccggccgttgcagcattgtggtacacattatactccggcatcaacagagccaatattttcctggaaaatattgatgcagtgcccgatatgaacgacgatacccgcaagcagtacaaagccgaagcccgtttcttacgcgcattctattattttactttggtagaatgttggggagatgtacctttcaagactacttctacagaagatgcctataacctctccattccacgtacggacaaacagacgatttatgattttatcattaaagagatgtatggttctgccgaggatctcaaatctgctcaagatttgaactatttaccgggacgtgtttctaaatcggctgcatggggaatgttggcgcgtgtatatatgttcagagccggtgaacctaaacgtgacaaggaagtgggtttggccaacaacacgactagtgccgagattacagaatatttcaaaaaagcaagttactatgcacagttagtcaagaatgagggtcattcactaactgccaaatattgggacttctttatcgacatttgttctgataagtataacactgctctcaataaggatggtgccaaggctaatgaaagtatttgggaagtagaatttgcaggtaaccgttcgacggatgtacgtgcagaaggtagaatcggtaatattatcggcattcagggtaaggacctttcttccaaagcatccatcactggtaaaggtgatccgggctatgcatacgcttttatctggaatactcctaaactgctggaattgtatgaagcaaacggtgatattgaccgttgcaactggaatatcgctccattcacttacacccagtcagcaggagaaggcactccggtagacggtcgtgaatttgtgaaaggaaaaagagatgaagtggaacaacaatattggaatcaatccttcagctatggcaaaacagagcccggttctacttacggtgatcgcgaatcgaagaatgatgccaataagaaccgcaatagagctgctgccaaatatcgtagagaatatgaggcagacaagaagagcaagaacgatacttccatcaacttccctcttctccgctactctgacattctgctgatgattgcagaagctgaaaatgaagtcaaccatggtcctaatgatctggcttatgaatgtatcaatgcggtaagagaacgtgcaggaatcaacaagcttgcagcaaatctggatgaaaccggcttccgtaaggctatcaaagacgaacgtgctatggaactctgcttcgaatatacacgccgtttcgacctgatccgctggggagactatcacaaactgatgcaggaacaagtggacaaggcacaggctgacgaatcctggaaattcggaatcaatgtatatacttacttcaatattccgaagtcttacaattatttcccgattcctgccaatgaaataggatcaaacggtgctatcaagacgaataatccgggttggtaattctcttaataactttaaaaagaaaaggacatgaaaataatatataaaagtttgatgactatcgcttttgccggactatccctggcttcatgcgacaaggaattaaaagaagaaacagcaatggaagtgggtgtggtgacagacagcaatgtcagcttcgatggcaaaactgtgactgtaaagaaaggaaaccctgtaacgttcagcttcgatggtgaccctgattttatcagtttcttcagcggtgagatagggcacgaatacaaacaccggaacagaattgaaatgcaaccggaagacgtagaaaaatgtgaaatcaacttctccgtagtatatgactatggtagtgcgaaaaccatcgaaggttctactcacatattaatatccgatcaattcgaaggaattagtggcaacaatgtggaaaaagacaaagaagcagttactaattgcgaatggacagaacttgtcagccaagatgagcttcctaaagcaaccaaagatactaaagactattcttgtcctttaatatcttacttgggtaaagaaatcagcattgctttccgcctcaaccctcttgataatagcagcacaatgcctgtaatacatattaaaggcttacagcttaatctggagttcaacaatggaaaatcaaccacaattaatgcaaagaacttcgaattctcggctttaaatgtaacctacaatttagatgatctttcaaaaaacaacactcatcttaccaaattgaaggaagcattaggaaataaaaacctcacacttgaagagatgaaaagcgcagaatatgcagataaaatagcatatgctactgtagacggtaatattccttatttctggagaattagccagccaagcgatttcgtaaccagtggcggagcagcagggtatacaaaaggagatacttggcttatctccaattccatcctccttaacggttcctgcgatcctgacgctggtgtagctatcaagaatatctcgcaatcgttggagatatactcacatacctatgaagaggccggtacatataccgctactttcgtagccaacaatgcaaactacgtccatcaaggtggtcaagtagtacgtgaactgactataaacgttgtagaataaaaatatatcccccaatttttctaaccttcaatcatagaaaacgtttataaaaatcagactttaatcaatttaacatcagaaagagagggaccgcgaggttcctctcttttactttttctgtatctttgcacaaaaataaaaataatgccaaagactcttcctattcattttgccccattacaaggttacaccgaagtgttttaccgtaatgctcatgctgcctgcttcggaggtatagatacttattataccccatttgtacgactcgaaaaaggcggattccgccatagagatgtccgcggaatcgaccccgggaataatcaggtagcccatctgattccccaactgatagccccttcttttgaaaaagcagaaaaaatcttatccctattcattgaaaagggatataaggaagtcgacatcaatatgggatgtccttttcccatgctagctaaacgccacaatggttccggcattcttccttatcccgaagaagttcagacgttacttagcctgattacagaatatccgcaaataagtttctccatcaaaatgaggttgggctgggaagatccggaagaatgtctgaaactggctccgattatcaatgagctacccttgcgacaagtggttatgcacccccgcttgggaaaacagcaatacaaaggagaagttgaccttaaagcgtttgaggcttttcagaatgcctgcaagcatccgctcatctataatggagatatcaatagtgtagaagatattcaccgcattcaggaacagtttcccggactagccggaattatgataggacggggattacttgccaacccggcattagctttggagtatagacaaaaccgtgcactcgagttcgatgaaatgagagaaaaattgcaatctatgcacaaatgcgtatacaatcaatatgcagaacagttggaaggaggagacgaacaacttctgaacaaaatgaaaactttctgggaatatttaatgccgcaagcagacagaaaattactgaaagcaattcataaaagcacaagtctcaacaaatataatcaggcaatccttgccttttttaatcaacgatgaactgataaccagtaattttacgtaattttgcgcccgtttacaaacatgcacattatgaaaaaatacattctaatctttctttgtctgataaccgtatcaggcagtttcgcacaaatgcaggatttcaagttcaaattctatggacagattcgtactgacttctattataatagtcgtgctaacgaagaaaccgtagacggattgttttatatgtatccaaaagacaaagtgcgtgatccggaggggaacgatttgaactcaacacccaacagtaacttctatactttatattcgcgccttggagtagacgttgccggtccaaaactgggaacagccaagacatctgccaaagtagaagtcgacttccgcggcacaggcacttcttattcggtcattcgccttcgtcatgcttatttgaatctggattggggaaaatcagctttattactcggacagaactggcatcccttattcggagatgtgtctccgcagattcttaatctctccgtaggagcaccgtttcagcccttcagccgtgcgccacaaattcgttatcgctatacaaacaagaatttccaacttaccggagccgcagtgtggcaatcacaatatacttcacaaggaccggaagggaaaacacataagtatctgaagcaaagctgtattcccgaattttatgtcggagctgattataagaatggcggtttgctggccggcgtaggcattgagttgttatcattgaaaccacgtacggagtctatagtaaatacagataaatacaaagtagacgaacgcatcacaactctttcatacgaagctcatgtgaaatacaccaacaaagactggttcatcgctgcgaagagtgtattaggatccaatctgacacaagcttccggtttgggtggattcgggatcaagtctgtcaacgaacaaacgggagaacaagaatatactccgatacgtttctccagctcttggttcaacgttgtctacggacagaaatggaagccgggaatcttcgtaggctatgccaagaatctgggaacaagtgatgcactatatgctcccaaaggaaatgatgcaaaactttatggaacaggaacagaccttaaccaattagttacggcaggagcagaactgacctacaatgtcccccactggaaattcgggttggaatatacattaagctctgcatggtatggttcgctcaatacgtccaatgggaaaattcaagatacccatgccgtatgtaacaaccgtattgttgccgttgccatgtttatgttctaacctctctatacaattattttaattatatatctgtcacttgtcaccgattgctgcttaacggtttgattattaacaattaacaccgtgacagcaataggtgacagcagtgtgacaacaataatgctgtcaccagaaacagataaactacatttcacaacgcggaggtattcactctggaagctccaggcaatcctatttatttcatgaatgcattacctttgtttctcgtggggaaacttttagtttcaaggcttgaaaccaaaggtttcgtaccgggaaactaaagtttcagcattgggaaactgtagtttcagcaccgagaaacaatagtttcaacggcatggaaactatggtttctccaagagaaactagtgttcccctatcaggaaaagcaaatgatctcctattgtctgacttttatctccttaactccacttcaaagctagcaccatctttacaactgaactgcaaaactgtttgcttcttatcagaagaaatcaccttgcaaaacggagtttcttctacattccattgcccttttatcgttacagtcacaggtatttcactactggcattttcaatccatggtcgtgaatagatactacgttcgatgcgtttcccatctttatcaaacgcttcatcgcttggaccgcgatacaaagctaaatccggttgtgccaccgtcaacttaatcttatcagcagatcctttatgaatcataaccagacaggaagtatccacacgttgtaataaaccacccggcaatgtcgtttcaggagtttcaaacaacacataagaaatgatctgttcggaaacggactctacaatatgtgcattccggtcttgctgtaataccttataagtgggcttctttgcaaatttcttcatcagagtttcattcgtctgaggcagaacagcgtattcataacttccgtttttcggtgcctttccatgatctacaaccaaagaaacccaatcaccctttgtttcctttcctgtattttgcattcgcgagtattgaggaaagttcttctcaaaccggatgggagttggaacataataacccgttcccaaatggtccacccatactttcttatctccttgataatttttccaataatcatgccctgctttatcagtaactgccaattggaagatagtcgtttctgtcgggaactccgtatttgtattttcaatatccgaaccaagacagacaatcattccatcgatgaaatggtaagatttacgtgcccgatgtgatccgttgtacttatcatgctcatgtaacttcattccgaaattaccattcatcttctgttgagacaaaccaccggcaaaagcctcgtcggagtaaagcatctcttccattccagagtaactatccacattgagcaccttagcctgcaattgctccaatggcaaatgaatagatgtcactcccggaatacggttccagtcaaaaccttcctgctgccagccgctagtggcgggagttactgtctgtcccggtgcagcagtcaatatttgcaaactgccgtgtgccaggtagcgaccgtatagatttgctcccagataatgctctgccgcccatagataacgggaatgtccgcgtgccacagccgaccaattgctacgacgttggacagagacgcaaccatatcccatcgctatatttccctgcggatccggttccggacggaaacctttctccacaagacgttttgccaccttacgttcttcagcatttgaaaccttaggcatatattcgggagagtcattttcaatacttgggtctgaaatcagacggaggtaagaagaagccatttcactatcatattcctcctttccatcgggagaaccagctagagccatcatagcaaaatgcataggaaccagtttaccttttccatccggatgacgaccggacatggaaagagggaagttcagcttattgcaatagaaacgcatggtcaacagtacatttttcactgtttcatgagctaactcggaaacagcaaattccgtccggctgaaaagataaatcatattggttgctccatcgagtccgcccacagcataagccggatagttatttcgatgatggaaagcacctccgtctactttaaacgaaccggataatcccaatgcaggacggcaaccaaaatcaatccaacgggagaaagaccggagatattgtagtttttccggtgtatcttccatcattaaaatgctggcaatgcgtcctgtggtctgtgtattgaaagagtccatatcaattccattaacttccggtttagggtatacttcgttagtaatcgcataccaacgtaacgtacgttcggcttcctgaagtttcccggtttccctaagcacatctttcatcagaaaatatgccaggtacagaccgcgaacactatagccataatgatggatatttccccaacaactaccataagctaccccctgatcggttatgtgatcgtacattgctaagaacttcttcttcatttcttcccgaatcaccggatttgccgcattattatatgcaacggcaattcttttcatcaggtcgaaataagcacgcatttccactcccattttagtcagcatatctttatcccagtttggtatgatccgttcataagcttctgaagcacgtaccatgtaaataggtactcccgatacttggccgttcttgtaagttatctgatagaaatcatatttcttgcggatggtttctacttctttatcagtcgtttttcctttcgtgtagatcatatcacgaaaacgcttttccaacagttgcatttctgctctttgcttatcgtctacaggagtcaattcaatatccggtttcaaaagcgagtgttgatagacaaccagccaatggttggtggtcccggcattgacaaaaggaacttgcagatcggccgtctgttgacgtgcatcaactttagtagccgtaatcaaatgatcgatgaaaaggcttccttttgaatttggagcaataatccggagttcattcatgccttcttccggtgtgccttgcatatcacgttcatagcaaacccatgcggcacgccaaccactgaaattaataccaaaagggaaagatgtgcatcgtttgccgtctttcagaaactgaaactcaatggtctcatcttggggaacttcattataaacccacacaataaaagccgaaagatataaatccttgccggtcggatctttcttctcaaacttcaggtctttcttgagttccaatataccacccggttcaaatgtccattccaacgaatgttttccatctttataatgcagatcagataccgacaggcgggaatgggtagcggtgatacaatccggtatttgcggttcttcaaaagaaaacatccgttcatctgttacaacttgtgcatgaaggaatgctgaacacaaaagagaaaacagagttgtcactccaaatttagtaaaaggttgtttcatcatggaaatatagtcttattaggttttcagtatataagtcaaagtatagtcgctttaaaatctgtaaagagtacgtgattctgcaaaagacgtaaaccgaagtatccgtcaccttcactacccgcaagggtatagcggaacaactcttcatcattcacagaataagttgtgattcccttttccactcgaatccgaatctcataccattgattggggacgagtaaatgagaggcatcggtatattctttcaataaaggtttcaccttgtcatctgccactccataatattctcctttgtatcgacggaaacgggtcgttgagttatcatttcctccgtatccaacgtagaaaaggtttaatgtgttatagtttttaaagatgccgtcacgccactgactacgggcaaaaagatcatcagggtatttaggatcattggcagcccagaagcagttcagatcactcaagcggtcatactttccaccttgcatcaccatacaaatacgataacttatttcataatcgcccgtcaatcgttgccgataccacatagtcagtccgtccggaactatcaattctaatgtatctgcactttctattatttgcaaagcatgggatgcatcttctattttccattgctgcacaaaagaagctttgtgctgtgccaaaagcaccacactatttaagagaaaaaaagtaatcaaactgtagcctataaaaaatcgcttcgtcattacggtattagtttaaagattattcttccgaatacaaagaaacccctcttttcgaaaaaagaggggttcaaattgtacaaaataactcaaataacgtattgactgataatttgcattaccaatatcttatagttttttcatcaacaaagttctcataccatttctggtttgaaacacccttactatctacccatttagtaaaatcaggatatgcttctctaaatggtacacgttcataagcatgacgtgtgccaaccggaagtttaactccccaagtggaacctttggtatttgaataataaacatttgcatccagtgtagtgtcacccgcaaccaatgcttcatattctgctttgtaagcagaagtcggtgcataacccctcatgtgtatttctttaccaccgttcaccttaataaagaaattctgtctattagtatctaaaatcaactctctaaatgctgcaagctgagcatctctttcagctccagttaatccttctttaccaatcagtctaacttcagcacgcaacataggtagtccttctcttacttttccttgtgttacctgaaacatatcctgattattatccatcaaagaagttaaaccatccagtgtaataacagttccttccgcttgtgctttatccactgtcaatattgcgaaacgcggttctttgcgagtatcattactccaattccaatttttattttcaactttcactatattttttgtagaaagttcctctttagctaagtctgtcattgttccctgaccaccttttagtataaggcttgcagtaatccgatcaacatactcgcttttcaaaccatccagtacaacacctaacacagtcgggtatataccacctacagcacgaacatccaaagtcaacaacaattcttctttacctcctacagtctccatcatctgttgactatgacattcagtcaccttcaagtcatactcgaatacaacatcgttgaaatcttcatcataccatgaatccagttgaataggccaaccatcttcgaacatcaccacacctgtgttatgatagaaaagatagccttggtccgtttcatttgtcggctgcactgcatcttcaggaagcgcaagagttaccgatgccagacggtttgtttcaaaattgaaaccagtactctgatctacaccacgactaacaggagacaaagcaaattcttttgtagcctctgttcccgaaactgtattgtatttcatatacactttctcgcaagcagcaggaacattcaacgtaagagtacgggaatctttcactaatacatctcccacaagcagactcgcttcagaaccacttttatcggaatatacattcacaagtgtagaagcatttaccgggtcaacagttcccgaaccatcgttacctttttccaactcattatcagagcaggaagtagtaaccaacattgtccccataaggacatacatcaaacttttaattttcatcttaatttaatttttaaatttattgtttgtttttgtttcgcatgagaacctggcttatcacacttattttcaggctccatttgttaacttatcaaaaatatatttaacgcctaatagctttttgcttgcctttatttgtaatttcaatcctttccatcgagaataatcacaagagctaaaatagggctcaaaaagcctgttcatgaacaatggataatatatacaagttatttcgtatatttgcattagacagaacattcaatacaacaaatatagaacttttattccgaatatacaagttctatatataaatatatcaagggaaatggatcaagtactgtatggtatagattacatagaatattatttctattggatatattacaagtttattggctatcctttaatcataagaatatgctcaattgctgtaatgttttgtattattgcgtacttatttctcctattccatattatatatggtatatttaaaaggcgaaaagagaagcggaaatacaataaagcatttgataagtattatgaagaaatgaaatctatctcactagattccaacacattgagtgaagaagagatagctgacagattagaatatgatacgaaaaagcgcccgaaacctaacgagttacgcattatcactcaactattaacagaaatcaagagtgtgcatgaagatgagatcaatgaactaaactatcaaacgattcaaaccgtattccaaatcacacgtttccttgaacgcgaacttcaattcggttccaaaagatcaaagatacaagctctgaaacttattcagtccatcaatggctatgcctctgaagcggtattggtgcgtttcctctatcatcgtgaactagaactaagaaactcggcacgctatacttatatgtggttaagccagggtgacccgttccgcttcttcgacgaagacatcggcatgaagttaaggcaatgggacatgatggagttacacgctatcttggagcaccgtaagaaagtgggatataacacacccacctttattaaatgggtgaatacttcagctgaagaaaacgttaagatattctttatcaacgaaatccggctatataatgaaaccgaaagtgccccaattctcgcgaagcaactcaatgcccgttctgtggaaatacgaggtgaagcgatcaagactttaggtaaactaaaatacaaagaggttgaacctaagctgattgaaatgtataatgtacaaccggaagaagtcaaacgacaaatcatttcggctattgcggatctaaagaccgataaggctttaggatttctttacaatgcttatgatgaagcagataactggggaaccaagagagtcatactcaaagccctctatgagtatagtgcaatgggaaggaaaacattcgatcaattggaaagaaaagcagattcccacacagctatattgtttgcccacaccaagcatccgttaatcaaccagttaaactagagaacatgagagatataatatttacattcttcaattatttcgtattcttttatacgagcatgctggcgatattcttcgtcacattcgccttcctctctttcatttctctaaaacggagaaaggattactatgtggaaagctatatgcggaaaacaatcaaggaatccccctatacaccgggcatttcggtaattgctcctgccttcaatgaagaaaagacaatcattgataatgtgaactccatgcttgcattggaatatccgcttttcgaggtggttattgtaaatgatggaagtacggacagtacattggaaaagatgaccgaatattatgaactggtagaagtgccctatgcttatatcgagcgaatcaaaaccagaccgttccgaagactcctcaaatcctccaacccgaaatacagccgactcatcgttgtagacaaagaaaatggaggaactaaagcggatgcatccaatgcgggtatcaacgttgcttctcatccttattttatctgcacggatgtggattgcattttggaaaagtatgctctttatcgttgtatctcgcccattatatcttcagaaaaacaagtaattgcagtcagcggaacgatgttgatggctaacggatgcgtcgtgaaagacggacaaatcatagacgttagaactccccgtacaccgattccacttttccagaatctggaatacatgcgttcctatctgattggtaagatgggatggtccgcaatcaatggtatgccgaatgtttccggtggattcggtcttttcgaccgttcggtagcgattgcagccggaggatacgatgccccctcttttgccgaagacatggacctcatcacccgcatggtaggatatatgtgcgacttctcccgtccttataagatcgtacagattcctgatacttgttgttggacggaaggacctcccaacctggcaatgctttaccggcaacgtacccgttgggcacggggattgttccagacacttaatatccatcgtaagatgattttcaaaaagacgtataaacagatgggactgttaactctgccttatatgttcgtttttgagtttctggcgccgatcatcgagctcgtcggtttgatagtatttatctatctggcctttacaggagcagtcaactggaacacggcatggatgatttacctgacgatctatacgttctgccagttcctttccatcgttgttattacctacgactactatgtcgggatgctatataaaagaggatatgaatacctgtggattatcattgcgtccatattagagcctatcttctatcatcccatcatcactttctgttcattgagaggatacctcagttatctgaccaatagagacttcaagtggaagaacatggaacgtaagggattcaagcagaaagaagaaagtgcagacggtactgatataacggcaatgaagcccgaacctgctacgatttaaacaagaaagaaagattaaagacaagatagaatgaacagagaatttctccataagatcaccatattaggttgtctgtttttactgataacctcttcctccgggaccgacaacggattccagacaccggagcaatatgcccagattgtacaggagcattttgcgaacgaggaatgggaagcagggaaagagctgttggaggagggccttcagaaatacccgaatgtttctgaccttgaatggctcatgggaaaatactggttccacgaaaagaactatgaccagtcgcgttatcatcttgtcaaagcgatagatgacaattacaacaacgtcaatgccaaacatctgctggtagatgtagaagatatcaccgagaattattccagtgctatttgttacgttaatgagttgctggaagtgaatccgtattggagaggtttatggcgaagaaagattgaactgtaccgcaagcagaacaacgatgtggaagcagatcgtctgttgaaacgaatcaatcagatttacccgaacgatacgattctaaggaaggattatatctacagcatggaggtaggctaccagcaaatgaaaaaaggtggtaaccgaaaagaggctatcgaaaagctgacggagctcatcaaagtatctcctcaaaacgaagaatattatctggacatcattaacctgcatttacaggaaggaaaccgggaagctgctctaggctggtcatccaacggtttggctgccataccgggaagcggtgcgcttatcgtcaaaagggcgagtatccttagtgaattggcacgttatccggaagctctggtgtttatacgcgagcaaatgcgaagaaacaacagccctgccatacggcgtatgtataacgacctgttaatggaggctgcccgagcagagaagcagcgggatccttatgtattatatggcatggcctacgaaggaggtaataagaacaaggaagcattagactacctgctgaacacttccgtcacccggggatataccgatgacgcactcttctatatcagagaagctaaaaaacaatatggcaacaatgataaaggaattctttataaagaatatatgctttatcgccagatgaatgaggatgatcttgcctattcaacgctgaaaaagatgtatgagatgtatcctgatgattatgatattacgcttgccatgagcgcacaacacatgaagaaagctgaaaaactgatggaacttggtctgtacgcagaagcattgccgcacgtattgttcgtttctcaaaaacatgtagacgacaatgaagtgaacggtgccgcatgggaaaaagccttgagttgctatatcaatatgaaacgttacaatgaagcacttgcaacattggacaccatcactcttcacttccctgattacgaaaacggcacgttgaaaagggcatttattctcgataaaatggataaaaccgaagaggctttgcaactgtatctatctgccatcgagcagagtgatgaagatatgcgcattttctatgttatcgggtacgaggaactagcagtgccgtacatcaagaaatgtatggaagccggagctacgaagaaagcatacgaggaatctgttaagctaattagcctgaatccatcaagcgatctcggattacggtatgccatcaattcgtccggtttactcggaaaatacgatgaattcgagaaatatacagcacaaggaatcaattattatcctgaagaaccattctatcaggctaaaagagctaccgtgcttgaacgtgacaagagatacgaagcttctttggaattcctgaagccgatactcaacaaatacccgagcaacaaagagattataggcgcattctcacagagcagtgaataccgtgccctgcaactgacaaaggccaaagaaccggaaaaggctctcgctgttcttgatacagctttgctttatgacagtcagaacaaatcattgaagtacactaagggagtggtatatgaagccaaccgtcaagcggattcagcctattattaccaaaagtactacgagccatccatcatggaatatcgctctttccaacgacatttatcgggccttagaagcatgatgctcaagaatgagattgctttgacctatctccgtgcacgctacggagaagaagatatcattacctctgttgcaacagccgaatatacccgaaaaggccagaagaacagctatacaggacgtctcaactatgcagggcgaagtggctcggcaagcgacagcatggaagcggaagagcagacaccgggaggagtcggcattcaggtacaaggtgagtggacgcatcacttctcaccgaagtggagcctcacggccaatgcagcctttgcgaccaaatacttcccggacataacggctgatgtcgctttacggcattatctcaagaatgattgggaaataggtgcgcatgtgggttatagacgggtagccgcctacacaaagcgttatgaatggaacgatgaattctttgcaggtggcaccggagacaatggctatctgtttacgggttggaatgagtcaaagactaacctactcactgtaggcggagaattagccaagaccattgaagtggttcgtctcaacacgaagatcgatatgcacttcttcaactctaacttctattacaatgcgcagattggcgccaaatacttcccggcgagcgatacaaagacaaatatcaacgccatggcaagcatcggatcggcaccggaaacggccgtactggactatgcgctgcccggctctttctctcacaccaataccatggtgggattgggaggtcagtatatggtcagtcccaacattaccataggcttgatgggcacttggaacacctattataaccaaaccaatacggtgcgagggacaagtccgtccaaccagatagaatccatatcgacacgctataaaaacttatataacatctatgcacaagtttatatttcattctgatacgcttggccctgtattggcaggaatgatatgtatttgctgccttttatccggctgccgtatgcaggcacgcacggagatgttcccatctaaagaagggtatctcgtcaccattggtgaggatccgaccgacagagacacccggtgggcgaaatacctgtacgaacatctcaagaagcgtgcaaacgacgatgaaatagtagcttttggcgtttccgaaatggacatgtggcgcatcatcatacagatagacccaacattgcagagaggattcaaagtagcctgcaaaggctctgatatcagactgaccgcaagtgacgacaaacaaatgttatggctgcaataccaactgataaagaagatcagcaaagaagacccgcgtatagacggttcggatcttcctcccgcccttatcaatctcaacgatacttgcggagcttttgcatttgactatcaaagtatttattctccatacggcctgaacgccgatcatacaggcgttatcggcctgaacaactttgatgacagctggggaatatggggacacaacctgcgaaaagtcttgggaaaagatgcagagaaagtatatgccaccattcacgggaagacagatgactcacaactgtgtttctcttccgaggatatgtatcgccagatagaaagttacatcgtagataacttcggtgaaaaggggaatttccgttttgtaatcgcaccggatgatactccgtacgcctgtacgtgtgccacctgcaccgcattgggaaatacagagaagaacgcaactcccgccgttacggaactgatcctccgcctgtcgcagcgttttcccaaacacacgttctttacgacttcctacctgactacgcaacaagtcacagacaagcagctcccgcctaacgtcggggtaattgtcagcgctatcgactacccgctccgccggacagacggcaaggacgagcaagacaagaaatttgcggaacaactcgacaactggaagaaagtaacgaacaacatctatatatgggactatatcaacaacttcgacgactacctcactcctttccccatattaaagatagcccagcaaagactccaacttttcaaacaacacggagccagcggcatatttttcaacggaagcggttacagctattcttccttcgatgaaatgaggacttttgtattatcagcccttcttatcaacccggagcttccggttgatgagttaattaaaagctatttcaatcaggaatacccggtatccaaaaaatggctgtacgattactacacagagctagaaaacaacgcccaatccggaaagcggctcggactttacgccggtatcagagaatcggaaaaaggattcctctatccggagaagtttatcaaattctatgatgaaatgggagattttgtatccgaagcaaaagggaaagagcgcaaaaagctgcacgagctccagaccgccttgtctttcacgcgcatggaattagcacgtgaccacagtttcgacgcttacggatatgccaagcggaatggaaaggatattcaaccgcttccccaagctcgtaaatgggtcacccagctcaaagagcatcaagcatttgccggaatgggatattataatgagtcagcttatgagattgactattatataaaggaatgggaacaatatatacttgcttccgacataaagaaaagtttgtttctgggaatgcatccttccgcaacccctaaactaaataaaaatgattcaaagaaactgaccgatggcactcacggtttacccggagactatcattgcggttgggttatcattccgggagaagaatgtaccatcaacctgccggttaaaggactcaatgcatcaggaacattctatatcagttttttgaatcttccccgccatcgcatctatgctccacagcaagttcaactgttgaaagacggagtagcctataaaacaatagacttaaaaccggaagactccccagaaaaaggagaaatgatgaaagccaccgttccggcagacttgaacggaacagaacaattaagcataaaaatcagttgtttaaagaagccgggaacgcaaatgggtatcgatgaaattgcattcatcccttaaatgctgaaaaagtgatataacaaaaataaatggcaacaatgaataaatctatattctatattttactactgacggcacttccgctctactttacagggtgcagaaaggaagtacgtcccaccagcatgacgataaaagattccgtcagacactattaccctatcaagcaaggtcagcaactcgatatcatgtttaccatcaccaacacgggagacgctccgttaatcatttcagaaatgcaaccttcctgtggctgtatcattctggataaaagttcgcatatcatcattcccgaagacggtatcaggcaattcaaagcaacctacaacagcatcaagaatgtaggcgaagttgttcaccgcatccggattttcggcaatatgctcccaaatggaaaagcagaactaaaatttgatgttaacgtagtccccgacgcagattatacacgtgattatgaagaactctatcaggatttcaacactaaaaacggcattgtcagggaaatggtagacggaaaagaatccgaactaggatattatgtaggagaaccctaataataagtattaagtatcaagtattaagtattaaatgactggctaatacttgatacttaatacttgatattgatacttatctctacggatgtatttctttgaatgcggcattttcttctttcacattctgaatagtctgttttaactccccaatcggcaagtcatatccataccagcctgtatagcaatccaccacataccatttcccgtcagcctgcaattcgaactcgacacgcaaatccacttcggactcttcatagcccgcttcaaagattttgtgtttcggttcattcagcgtaaacttggagacatagattcccccttcttcctgggtgatacgttcttccttcatggtttcgctatccagcaacggccatttttccttagtgaaagggaacgtcttttcggtttcgccgtcatctgccaataaagtaatcggggtctttaatgggaacttgacacgagtatactggaaggctgcactggaagtaaatttatccagaaatgatttgaaatcttcaccgtcttgcgtagtcagttcactatcggcttttgccttggaactattaccgcaggagataaacgaaacaccggcgaacagcagcatagccagcaagcagcatacaaactttttagctctcataacactatacaaattaagagtttaattgacggcgcaaagataatgacaagtttggcatcttggttattttaagaactaaatatttgcgtctatataatcaatttcccgaatctatgtatgtttcagatattcataaccgaagcgacagtacagacactttcgcttatcacaatactctttttgcaactgtatcaatgcctgactatccgccgcactgacaaccggaagcccggcatcgctccacgagcggataatatgattactctccgccttcaattcttccagaaaacgtccggcacgttcacacattcgttcatctgtcttatgcagaccgtatgtataaagaaaaggaaccactgtattaatgataatcaaatccttggaacgctctcccatcgtcttctccttttgtgaagacggtcgcccgaataaataatgattttcccaatagggagacgtacgggcatccagcaaggttctcacatccgccagagtttccgcttccaacaaacgtgaaaacaacttatcccctttctgatagagataagctaattgcgccaagcgaatatgcggaaagttttccggacgaagccgtagaaaacgccataacgtagcgtccatcccctgcccgatttcaaacttccgctgcaaataacggaactccttgcaaagacggagactatactcgtcttcctgttcctttttcagaaacgtttcttccaacaatcccgccaaaccatagaaaaaagcctctatctgaaacaaatcattccggtgcttatccagcgcacgaaacggcagtaatcccgcccacgtttcgaaagcatccccattcaagccaaaaccgaaattacgggcaagggtgataaagaatgcatcttcccaattacggttacaaagcgcgagacgctgtgtgattaatcgggctttctgctccaaacgttctgtttgcaaagcggtcagccaggaatgaatggtaagtttgggaagagaggcaaggatgggatggcaagccggatactgatcggctacacaaagttcatggtaatgcaatcgcacattttccgggcaagtcagtaacagttgcggtatctgttcaccgttggtacgggttatttccgtatctgcttcactcactacatggagaatcacagagtcgtatgctttgtcagaatgatgtccgtggcgaaaccagtcggaagaatgtgtatgtatttcgatgtttcccacccataaggcgccgtcaatctttagtttcgcgttgaaaaagtcgggaccggcgttggggttttgcagaccggggtcaatcacttctaccggtaagccgttggtggtttgcagtactttcaggggaaataatttatgtttccacacgtagtggagaagatgttccatgttaacaagacgttaatgtgcgctgcaaatgtaataaaaatcttatctttgcgactattattttgaatataagtcagaaaacaatgaaaatagcactgatcggttacggaaagatgggcaaagagatagaaaaggttgcccgtagtcgcggacatgaaatcgtctgcatcattgacatcaataatcaggatgacttcgaatcggaagcattcaaatcggccgatgtggccattgagtttaccaatccgatggtagcttacagcaattatatgaaagcgttcaaagccggtgtgaaactggtatcgggcagtaccggatggatgaccgagcacggcgaagaaatcaagaagctctgcacggaagagggcaaaacactcttctggtcgtccaacttcagcctgggagtcagcatcttctccgctctcaacaagtatctggctaaaatcatgaatcagttccctgcttatgatgtcaccatgagcgagacacatcatatccacaagctggatgcccccagcggaacagccattacactggcggaaggtattctggaaaagatagaccgtaaagacaaatgggtgaaaggaactttccttgcgccggacggaaccattagcggaaccaacgattgtgctcctaacgaacttcctatcagttccatccgtgagggtgaagttttcggacttcataccatccgttatgagtccgatgtagacaccatttctatcacccacgatgccaagagccgcggcgggtttgtattgggagccgtattggcagccgaatatactgccacacacgaaggttttttgggtatgagtgatttattcccgttcttgaatgactaaaatatcagaagctagttctaaacaaatataacattatgagacaagccacacgcgcacaatggatcaaatgtgccactgctattctactttacctcatcttccttatctgggtacggagttggtggggattgattgttgttcctttcattttcgatatttatatcacaaagaaaattccctggtctttttggaagaagtcgaagaatccggctgtccgcagtatcatgagctgggtagacgccatcgtgtttgcgttggttgctgtctacttcgtcaatatctacatcttccagaattatcagattccttcttcttcattggaaaaatcattgctggtgggcgacttcctgtatgtgagcaagatgagttacggtccccgcgtaccgaacactcccctttccatgccgttggcgcagcatacactgcctgtcttcaatactaaatcatatatcaagtggccacaatggaagtacaaacgggtaccaggcttcggcaaagtgaaactgaatgacattgttgtcttcaacttccccgcaggagatacggtagcagtgaactaccaacagacaacggacttctatacgctggcttacggcgaaggacaacgtatctattccaaacagattgaaatggatagtctgacacgcgctcagcaacgtgccatctatgatttgtactatgctgccggacgtaaacagataatgaacaacccgcgtacttacggagaagtcctctggcgtccggtagaccgtcgcgagaattatgtgaagcgttgtgtcggcctgcccggtggcacccttcagattgtagacggacaggtgatgattgacggtaaagcgattgagaaccccgaaaacctgcaattcaactatttcgtacaaaccactggtccgtacattcccgaagatatgcttcgtgaactgggtatcagcaaggacgacaccatgctgatagaagactccggctgggaaagcggactgctggaaatgggactggacagccggaatgcacagggcaaactgaatccggtatatcatttcccgctaaccaagaagatgtatgaaacgcttttgggcaacaaaaagctaatcagcaaaatagtaatggaacccgaagattatgccggacagatgtatccgctcaatctttataccaaatggaaccgcaacaattacggtccgatctggattcctgccaaaggagctaccattaccctcacagaagacaacctgcctatctatgagcgttgcatcgtagcctacgaaggcaataagctggaagtgaaaccggacggtatctacatcaatggtgaaaagaccaacgagtataccttcaaaatggattattactggatgatgggtgacaaccgtcacaactccgccgactcccgttattggggttttgtacccgaagatcacgtagtgggcaaaccgattgttgtatggctatcgcttgacaaagaccgtggatggttcgacggcaagattcgctggaaccgcctcttcaagtgggtagactgataagtgtacggatagaatagagtgataaggtgataaaagttgatgaacattcgtaaattcaaatggatactagcatttgccggagcagtagtcgtagtgcttctgctccggggatttgctttcacgtcctgccttatcccttccaccggcatggagaattccatttttcagggtgaacgtatcctcgtcaacaaatggagttacgggctgcgggttcctttcatgtcgcttttctcttatcatcgctggtgtgagagtcctgtacgtcggcaagaaatcgtagtgttcaataatcctgccggaatccggcaacctgtcatcgaccgccgggaaatctatatcagccgttgtctcggagttccgggagatacgttgttggtcgattctcttttctccgttatttctccggaggcacagtttaatccggataagaaaagactttattcgtaccccgcttcaaaagaaaatctgattacgtcactcatgcatactctttccatcaccaacgacggattgatgggaagtaatgacagcacccatgtgcgcagtttcagccgttacgaatattatctgttggaacaggccatgaatgggaaagagagcttcgttcaacctttgtcaaacaaagaagatgccgaaccaaatccgctgattgtccccggaaaagggaaatttatccgggtctatctctggaacatgaccttgctgcggaataccctcgtgatgcacgaaggcaaacaggcagaaataaagaacgacactctatacgtggacggaaaacccacacaacactgttatttcaccaaagattactattggatggggtctaacaataccgtcaacttctccgattcacggctcttcggatttgtcccgcaagaccatatcatcggaaaagcctccattatttggttctccaaagaaaaagaaacagggttgtttgacggatatcgatggaggcgtttcttcagaacagtgaaatgatcttccggatcataaaagaaacacccccttcataatatctcataatatccttaataacagagcctcctaaacgaattaaaatgaaagaaatgaacatcgcttatttatcttcagcctatctcgctcccgttgaatattataccaaactactggcttatgacaaggtatttgtagaacaatacgaccactatataaaacaaacctaccgcaaccggtgcaccattgccggcccatcgggtgagttagccctttctatcccaaccgtaaaacccgacacattgaagtgtccgatgaaagatatccgcatctccgaccacggcaactggagacatctacattggaacgccatcgaatcggcctacaacaatactcctttctttgagtactacaaggacgacttccgccccttctatgaaaagaaatacgagtttttaatcgatttcaacgaagaactctgccggatggtctgtgagttgattgatattcaccccaccattgagcgcacttccgaatataagatggagtttgctcccggagaatccgattttcgggaagtaattcatccgaaaaaggatttcagggaagtagatacagaatttgtcccacaaccttactatcaggtttttgagtccaaactgggtttcctgcctaatttgagtatcatagacctgttgttcaatatgggaccggaaagtctgttggtactgggcaaacaatgacctcacttttctatcggaatgtaaagttacataagtctttataattaccgaatatctcacagtaatgccattactgcatttcttgtcatttgttatcctttctttattaaagactttcctttttcagtcaggcgatacttctgctttggacttctcagttgctccgggaaaataggttctagcactcctatttcaatagcgggtcttaagtattcttttgaaaagtaactacgatttttcaagcctaaaagttccatcatttccttaacggaatatgtgctatactcaataacatttaatagagtctgaacttgtatggtacttatgtggtacttatgtggtacttgtacggtacttatgcggttatcctccccatatcggaaaataagtttcacaaaaccattagataactcaaattccggttctggcaagtttgctttttgacattctttcgtcattaaacttataccacgcccccaactctctaataatttacgtctgtaaagcacattggcaattaaaggattctgtggttctgaacaatgttcggatttcatcttttccatatcccaatcacgagggaatgtacccggattttcgatttccacacgatcatcatagatagctattcctacagagccgccaggagttcgaagttgtctatgacaaagcgaattgacaaccccttcccgtatagctttataaggaatcgtcaaatgctcttctcgttccaacccttcggttgtacccgacagagaaagatgcttaaatataaaggccattgctgcatcaagcaatttgaacagattaccttgcacgcgctgattatccataaagatcattttatccgttcctttgaaacgtgccaatctcaagaggcattgtggatattctatcagttcccgattagcaaacagtatggctgcggcattgtttaatacaccatttgccagcaacccgaatctctctaaaataacggcaacattgttccccgtgttctctggtagacgaccacattctattccaagcctcaccgtttttaaaatctcattctcatccatatcctgtatagagagtttggtgttttcaaacaattcccaacggtatttcgcttcgtcacgaagcatcagcaatcggttgtacaccgcttgcggcataattgacgtcacgctttctacacgataataaggacgacctttatagcaaaacggacgatttaaccttgaatcatcgacataaagggctattatctttttattgctatctgaaacaggtatataagaaacttgcactgtggctgttggttccaatctgttaatagcttccgcaatacaccttttagttacatcagcaacttcttgtccgattattttccctttgtcagtaacaccgaataaaaccgttccaccttctccattaaggaaagcgcaaagtgtttccattcctcgctccaactgtccggtggtttctttaaattccagttgttcattttcagtctgaacaatcaggttttttatatcttcaagattatctattttcataccatatattattgattcacaaaagtactcttttttttgtaagatagtagcatagaaacaagttacttccctaccaagacagttcacacaataggtatattgaaaaatgaaaccacctttatcttcttaaaaggtgattaaggtttagcgatagcatcatacatcataatactataatcccgtatcatactctcaactaaaccataatcactaaatgagctctataaagctgtttataccgctacttcttcacgattcttctcttcattagattctgccgcatccaaccgattcaataagtatcgtacattctgaagatgtatattgttattccgatccatttttttaaattgccaactgtttttagtggtattcagtatacaattcattaacgttcccactgcatcagcactctggaaacgattggtattggagatttgcgtattcatcatgtgcgcgccgaatcctctaatcacctctttcacacttatcgacttataagtacggatggcttcaaaggccgccacattactataaagcgtattagctaaatcctccagtctctttcggtctgttcgttccaccagatagctttcaggattcataaaacgattgagagtcagataaaaagccatcatttcatcatcggatgaaaagataacgtgcatgagttgcgtcgcgtcccccggacgggcctgctgattgcttaaaacttcttccataagaattttaattaaatggtgaataaattaagtttaatggggcgatacagaaaggtagttttaaggaataaaagaagcggttccgcctgtcccattgctcttcaccatccacaacaggcagtaggtgcattaacatcctacatgggggtgcgaaaccgccatataggaaaatgggacaagcataaaaaaagcttgccacactagatacagcagtttccctgctgtggattttgataaagagcattgcaaagatagaatataaaatcagaaaagagaaaagaaaatcagtattaattgaagtttacagcaataagcttaagacagaactttctaaagcctacttgcaactataagattcattttgaaggttcaccggtttcacctttagctgaatgactataaatcaaaatcttatggtgaaagaggatgtaaaatacagaaagaaccatctttcacctccttcacaaagataaaaagccgagggataaatgacaagatagcactgtggagatgcttacatcatataaatgagtgtatacatccaatttgttgggtatatatatccaatgtattgggcatatatatcctgcacgttggatatatatatcctacgtcttgggtatatatatccaacaactcaagtattaataacctagatacaaagtattaatagcctataactcaaatattaatacttaaaacaacggcacagtacctttcacatctctggatgcactaccgatgactgcctcaaactcgtacaccattgagcaagattaataaagctatttcgcaattagtttcaagccttgaaacaaagtgtttcaagcagggaaacgaagtgtttcacaccgagaaacggattgtttcaagccttgaaacaattcttgaaactaatcgctactggtgaagtaagcgtctccgcgattctatatagtgtattaaaataaaaaggctaatgatcccactaactcgcaatgaattagttgccttaaattttattattttaggaatatccctaactagtatggttgagtagtgatcaattagtttataaagttgataaacttataagccgattgattttagatctgcccgttctccaccatcaacactacacgttccgttagtttgtcttcaccttgcggatcatattctttttttaaactggctccgaacaatgcagcaaaagtctgatagaatcccgctttgaaaggtcccataaatgctttcaccagttcatagctggtagaattgctttggcggtctattagtttaatcaacagtttcccttgtgcaaaagagagttttttcattcggggagtatattgctctttcaatcctttttcaacccgtttgatatgtttttgacgggctttctcattgggtaatgtctgaagatattcgtaagtttcgatgatggcttggttaatttctctggagataggatatacctttttcacattgcggatcaggcgataatattcctggcgttctttttcattcttgaatttcaacggacggaaaatatacacagttcttaactggacacatggaatggtatctccattgtagatacacatcggaaccaaatatccattgatgctttgtttttcttgagcttgcaggcgcaacgaacaacaaacaatagcaaacagcgtcattactactatgttaagcctccttttcacgatacaaaaatagaattaaaattttattattcagacatttctcttcgatgttaacctatttaaagtatctttgcggccttatctgttaaaaagcaggaagaataaaccattttattgatgaaaactattcaacttttacggttgataagtattataaacagcctgttaataattcctgcttgtagtgctcaaaacccttctgaaagtcttttagaagatgttcttgaagatttatctgttaataacggaactgataactctgttaatactcctaatttggaaaatgaattggaagaactttccaatcgtatgcaggaaccagttaatttgaatgttgctacccgtgaacaactcgaacagtttcctttccttagtgatattcagattgaacatctgctggcctatatctatatacacggacagatgaaaaccatctatgaactccaactggtagaagagatggataaacaaacaatccagtatttactaccttttgtctgtataaaagctattaacaatgaagctgcttttcggtggaaaagtctgttggaaagcgcagcgaagtatggaaaaaatgagctgttaactcgctttgatataccattttataggcgaaaaggttatgaacatacctatttaggaccttctgtttataactctgtgaaatacagtttccgatacagtgaccgactctatgcaggagtcgttgctgaaaaagatgctggagaaccttttggagctttacacaatcgctacggctatgattattattccttttatctgttattaaaagattgtggacgattaaaagcattagctattggtaactatcggcttagtttcggacaaggattagtgattagcactgattatctgatgggaaaaacaatttatgcctcttctttcaacaatcgcagtggcggaataaagaaacactcttccagcgatgaatacaattattttcggggagtggccgccactgttgctttatctaaagattgggatctttccggtttctattcacaccgttcattagatggagtaatcactgacggagaaatcacctctatctataaaaccggactgcaccgaagtcaaaaagaagcggataaaaagaacctattcaccatgcaattaacaggtggacacgtgagttatcaacacaaccgtattcgactgggtatcaccggtatttactaccttttcaaccgaccatacgaaccggaattaacaggctattccaaatacaatcttcatggaaacaacttctataatctggggattgattatgcttaccgctggcatcgtttttcttttcaaggagagacggccatcggaaaacaaggttgggcctctttgaaccgtttgcaatattcaccggttcaaaacactcaaatcatgttgatacaccggttttattcttataactattgggccatgtttgcccattcttttggtgaaggaagtacgacacaaaatgaacagggatattatatcggcatggagacttctccttttgcctattggaaattcttcgcctcattcgatttattttcttttccgtggaaaaaatacagagtaaataaaccctctcgcggaacagacggattgcttcaagccactttcactccacgcagccatctatccatgtatctgaagtaccgctataaacgcaaagaacgggattggacaggtagtaaaggaacactaacacttcctatttttcaccatcaacttcgctaccgtttgaactattctttaggagatgtgttaagcagtcgtacaactttagattataatcattttcattctcaggacagagctgctaatataggatatcaggttacacaaatgatatcctcccaactgccttgggccaggctgtttgctgacgttcagggcagttacttttttacagacgattatgattcgcgtgtatatgcttcggaaagcggattgctttatatgttttacacaccgtccttccaaggttgtggatttcgctgctccgttcgtttcagatatgaactgaataagcactggttgttcataaccaagtttggcgaaacagtctatttagaccggaatgagatcggttcgggcaatgatttgatctgtggaaataaaaaagcagatgtacaaatgcaactgcgtattaagttttaatgtatatttgtctgccagaaataacagaagaatacgatattaaatggatgacagggctacttttgacaaaatgtttaatgaatggtatgcacagtttgtatattttgcatattattttataaatgacgctgaggtatgcagagatatcgtaagtgatgcttttgagtatttgtggcgtaattatgaaaagatagaagaggcgacggctaaaacttatctttatacaatcattcgtacacgttgcattgactatcttcgcaagcaaaatatccatgaagaatatgtagagtttacttcgcaattaactgataaaatgatagaaagcgattcgcaacattctgattctcgtgttttgcgtattcgtaaagctatggaaaagttgactccttataattatcatatattggaagcatgctatattcataataagaaatataaagaagtggccgaagaattgaatgtaagtgttgcggctattcataagaatatagtaaaggctttgcgtattcttcgcgaagaattgggtcaagagggtaaccggaatagactttaaaacgtaaatatatatattgaatacattatttatggatgaaaagaatataaatataagtaagtcggaagaagaactcctggaaattatggagaatcgttctcatataactactgatcaattgcataatttgaaagaagatgaggagtgcttgcaggcatattctgatttggcagaaattgtgatagaaatgcagaaaaaacaaaatatgctggcaattgatgtccggaatgaattggcagattttcataataaacattctaaaaacgatcgaagaaaaaatacgcggatactgttgtgggccagtgccacgggtgtagcggcgactgttgtcataattttagttttgcgtgcaatgatgatttcgtcgcaaccggaaatcattcaagtgtttcaagccaatcatgttgcccaagaagtcactttacaagtgaatgatgagaaggaaataaaaccactaaaagaagtggtagaatctctttcgtcttcctctactgcacagttgtcttctaaagaaatagattatagtcgtgctcttcttcagacagaaaccaaggaagtaggaaagcagaaagtacagatacatagattaagtattcctaggggagagacattcaaagtcgttttatctgatgggactgaagttttcttgaattcggatagtcgtctggcttaccctacggtttttaaaggaaaagaaagagtcgtctctttggaaggtgaagcttattttaaagttactaaagatgcaaaacatccttttattgtgaaaagtggaaatctacaggttcgcgtattaggaacggaatttaatgtgcgtagctactctcctattgatgtccgtgttacgctcattacaggaaaagtggctgttagcgatacttgtggaattcatagtgttgaaatgatgccgggacaaagtgcacagctttcttctgacggaacgtttgctgtgaacgaggtggacattgaatcatttttatattggaaggaaggatttttctattttgacgatgttgccctggttgacatgatgaaagaaatagggcgttggtataatatagatattgagttccgcaatagcaaaattatggatcttcgtatgcatttctttgcaaatcgtcaccaagacatctttcacttgattgaattattgaatcgaatggagaggatacatgctcattttgaaacaggaaaactaattattgaataaaaaacgagcaaaaagtcataaatctgaatagaaatatatatttctgaaaaataaattcttttaagggtaaccattcttttttaaacttcgtatataattaaaagaatgaaatattatttaactattcgggcttatgaaaaagaatcaagcacaaaagttcattgtcttgttcttgtttttcctttttgcctattcatggcgtgttgaagcgcaaacaggtaaggaaaagcaaataacaatggagtttaaaaatgaaggattaccctctatttttaaacgttttgaaaaagtatcgggatataaagttctttttatctacgatgaaatcagttcttatacttctaccggaaaagtagaaaaagctacagtcgatgaagcattgaaagtgattatcgggaaaaatccgttgaaataccacattgacggacaattcatcaatatcacaaaagaggattctaaaaagtttttttcacaagtaaaaggaaaagttttttccgaggaagacggacttcctgttatcggtgccactattatcgtagaagatgccaataatattagggctatcacggacaataatggtaattttcagctttctaatgtttcgaaagatagtcgggttagaatatcgtatgtaggtttggagactcagttcttgaatccttcatcctatatgtcggtagtgatgaagtctgatacaaaagcactcgatgaagtggtggtgacaggtatgtttaatagaaagaaagagggattcactggttctgctgttactatcaagggtgaagaactgaaaaagtatagtacgaataatgtggctaaagcgatagctgctgtcgctcccgggcttcgtatcatggataatatcaatatggggtctaatccgaataatctgcctgatatgcgtatgcgtggcggtgcaaatatggatttgaatgcacaggctacggtagatttaaattctgccagtaatgatgtgctggcagttcagggcgaatatgagacctatgccaatcaaccgctgcttatcatggacggatttgaaatcagtatacagacacttgctgatatggatcccgaccgtgttgcttccatcgttgtgttgaaagatgcggcagctacggctatttatggttcgcgtgcggcaaatggagtaattgttatcgaaagcaagactcccaaaccgggacggatttgggtgacttatggtggggaacttcgtattgaagctccggatatgaccggatataatttaatgaatgcaagagagaagatagacgcagagttgcaaagcgggctttatacatacggtggtgagacagttgaaaaatggcagctctatcaatctaaattgcgtgaagtgctggcaggagtaaatacttattggctggacaagcctttgcaaacagctttccaacaacgacatacggttacgttggaaggtggtgacgaagccttgcgttatcggatgtatgtcggatataatagttctccgggtgtgatgaaagacagtaagcgtgatgtattgaccggttcacttgattttcagtatcgcctgaaaaaggtgttgttaaagaatagtattacgttggataattcggtggctaatgagtctccgtggggaagttttagtgaatatacccgcttgaatccttatctgcgtccgtatggagagaacggagaaatacaaaaacggcttgataatttcgaaggagtgggtggtgagtcgagctacctgaatccgatgtataatacaacattcaacagtaaagaccaaagtaaaaactttacagtacgtgaacttttcaaggtggaatataatcctactaatgaattacggtttgaaggagcttttaatttgtccaaaagcgtaggacatcgtgatatttttcgtcctgcacaacatacgctttttgataatgtgaccgatcctaccttaagaggtgattaccgcagaagtcagagcgaagctgtcaattggggcatagatttaacaggaagctggaataagcaactggaagatcactacctgactgctaatgcacgtatgagtgtattggagaataattcggagacttatggaaactatgtgactggtttcccgaatgataatatggataacttgttgtttggtaagaaatataatgagaaggtgacaggagatgagaggacaacgcgctccattggttgggtagctgctggaggctattcttataaatataagtattcgttcgactttaatatacgcttggacggttcatcacagtttggaaaaaataaccgttgggctcctttctggtcaaccggattacgttgggatttgaaaaaagagaactttttgaaagatgtatcttttatttccgattttattttgaggggtacatacggtacgaccggttcccaaggttttgatccttatcaggcacatggttattatacatattccaatttactgcttccttattactcatcggatgcaacaggttcggaaatcttggctatgcataatgaaagtttaaaatggcagactacaaaaagtactaatcttgccttggaactcggttttttcgatcagcgttttactgcacgtgtggaatattatcggaaaataacagataatatggttgccaatataagtcttgctccttctcttggtttcagcagttatccggaaaatctgggaaagatagagaataagggttgggaaatttctctctcggctattccttataaaaacactgctaaacaagcttattggacaattacagtaaacggttctcataatactgacaaactattgaaaatatcggaagcgatgaaatacagaaatgataaaagtgcatcagatttaaaagatacgccgttgccacgttatgaagaaggtgaatctctttcccgtatttgggtagtacgttcattaggtattgatccggcttccggagatgaaatattattgaaacgtaacggggagatgacgagtgccgttaactggagtgcgaatgatgtagtacctattggtaatacagaacctaaatggcaaggatatattaattcttcctttacatacagaggttggggagcagatgtcagcttcaggtatcagtttggcggtcaggtatataatcagaccttgcttgacaaggtggaaaatgctaatttgaaatataatgtagatcgacgggtaactcagctacgttgggcgaaaccgggtgataaggcacagttccgtgttcttaatcctaacggtttggaaacgaaagccacttcccggtttataatggatgaaaatatattccagggaagttcgttgtctgtttactatcgtatggatcgtactaatacaaaatttattagtcattggggattgagttccgctaaagtgacgtttaatatggaagactttttctattggtctacagtgaaacgcgaaagaggtttgtactatccgtattcccgtcagtttacatttgctttgaatgttgctttctaattaaaaacctatttgtatgaaacagataatatatatactattaacaacaacaatgctgggacttatgtcttgcagcgactggttggatgtatctccgaagacttctattcctaccgacaagcaatttgagtcggaatcaggatttaaggatgcgcttacaggtatttatttgaagttgggaaccacgacattgtatgccggagacttgacttatgcttatttggatgagttggcaggattatattccgattatccggggtataatacaaatgctgttttcgatcaaagtatcgtattcgattatgagaacatgtttttgagtaagaagaatgggatttactcaacgatgtataacatcatagccaatattaataacttcttggagtacgtagacaaaaataaagatgttttagttaccgaacgctattatgaaactatgaagggagaggcactcgggcttcgcgcttttcttcactttgatttgttgcgtatgttcggtcctgtttataaagaacatcctgcatccaaagctataccctaccgtattgcttttgataaggatgccactcctgttttaccagccagcgaagtggttgacgctattctcaaagatttgaatgacgctgaaaaattactgaaagagagtgatcctcttgatttctttaccgatcagacggatgaagattttacagataaaaatcattttcttgtcaatcgtgagtttcgtatgaatttatatgcggttaaagctatgctggctcgtgtatattgttacaaaggtgatgcggaaagtaaaggattggccacagagtacgctaaacaagtgattgctacctctaagtattttacattgtataaatcgcagactgcttccaattacaattccatacgctacgcagagcaaatctttggaataacagtcaatgaattctccaatttgcttattggaaattatatggatatggagaataccaatactcagcaacatttctatctggatggagataaatttaaattcttctatgaaactgccgatgcagggaatactgactggagaaaaaatacggaaatgtttgaggttattaatggggcaagtcggacagatgttttttgtagaaaatataatcagaaacctttgaatggcggatatgcttattccggtgctgacgctatccctttgatacgcttacccgaaatgtattatattgttgcagaatgtgttccttctgcatcggaaagtgctgatgcactaaataccgtacgttttgcacgtggtatttcttatagtgatgagatatcgtctatcggatatgatgaccttgataatacttcggaagaagacaaaaaccagactaaacgtattaatgagataatgaaagaatataggaaagaatatttcgcggaaggtcaacttttctatttcttgaaagcgcataattatagcacttattatggttgtgggattgaaacgatgactgaagcccattatcagatgacgttgccggatgatgagtatatttttggaaacaactctaaatgatgaagcattatgaaacgtattatatattttgttttagctattcttgtttgcggcatttatgtaggatgcagtgaaaacgagatagacttatatgaccagacacctcgtatcaatttctatggtagcactacgcatgtccgtactttggttgatacggattatgtaaagaaagaaccttatgctgtagacagttttgaggtaagaatacaaggagattttttgaaagagaatcgtgatttctgtgtgaaagtaactccgaataatgattatcagaattcagtggatgtattattggaaagcaagtatacatatactgaccttgatacagtttgccagatattctattataaaataaatcgtccgaaagtacaggcaggtagaaatatctatggttgttatctggagtttgatttgaataaccctcttcatcagtttgataaaggtctggtagaaaagaatcaaatcgttttaaatgtcagatgggagttgaaaccgaccgaatggagtgattatgtgggatttggcagttatagcgatgctaaatatatgtttattatggatgtatgtcaacgtgtatgggatgacttggaagatgaagatattgatgtaatcaagcaagcttatagagaatataaggaggcggggaatccgccgattttaggtgaagaaggtgatgaaatagaatatgaataagattaaaaagaaacgttatgaggaaatatatcatctgtatagtaagttttatcggagcggctttattgcaaacaggctgttacgatgacaagggagattacgattatcatgatgtaaatacgatggatatcgtaatacctgaaacgaaggtacgtatgcctaaagaggaagcagtggaagtttcaattatacccgagatttctcagactttggagcaaaatgaggaaaaccttgtgtttcaatggaagaaaacaattgaaggaaagaaagcggggtcggacagacttagtgattataaagattattccgtaggtaaagaatgtaaagtaacagtcgagccttatgaatcggaaaatataggtttgatgttggtcattacgaataaaaagaatggaacaacctggtatcagataggtgaagttgcaattattcgtcctttaaatccttgctggtttgtattgcaggaaaaagaaggaaagggagtattaggagcgatagagggtactccgggaggatattatgtttatccggatgtctttaaatcagaactgaatcagtcatttccgttagaaggaaaacctttggcggtaagtgcaagaaaaaactatggggattcgtatttgagtagtatgctagttttttttggttttaaagtaagtccggcgttaatggtagtaaccgatcaggacttggccttattgactccaagtactttaataacgagatatccgtcgaataaaatactttttgaaccgacgggaaaaggggaaccgttgaatattgagttttataagatgagtgctcatggtgaattgtttgtaaatagtggaaaagcatattgtgctcctatggatggattttgtgtaccattctcggtaaaaaaggaaagtgagtttcccgctatttccgcttatggttcgtatggaggaggctatttgttttttgattctgaaaatcatcgttttcttagtgcatctattccgagttattatgattatatgatgaatcaggctactcaaaatatacgtaattatggtactaaatggagtgaccagaagcctgtatccacgtattcaatgtcagacgaatctaatttgtttgatccggatgtaattgatccgtctttagaaatacatgatattgttacggggggaaattggggaaattttgcttatgcgattgcttctccccggaacggaaaagagctgactgtgtttaaattcagtgcgcaagatgaagatccgatttgtgctgcccggtatacgattgctttaccgtccgaagtaaatgtagaaacagcaaaatttgcagcttcttacgcgtatacggcaaaccttatatttatgacatcgggtaataaattatatcgcattgatcttgaccgcggaagagcaattgaactttatacttatgaaactgatccgtcagcacagatagttagtttaaaatttaaggaccctgaaagtgtgagagaggaagatgacgatgaggaaacgggcgaatataaggagaaactaggcatgtccgtcgggttgggtatcaatactgctgccaaaggtgtagttgtagaattgcaattgacagtggcgggtgatgtagctcgtgaagaaaacagcatttgtgtttacgaagatcccgatcagcctattgggaagattgttgatataagctataattatgaatagtataaaccggtctttatgctaaaaggaattatcggtgcagtatttcttgctgttgtctgtacttgtctgtacgggcaacagcaaagtattacaacttttattaaagaagaagcaccagtggaagttattcccggtatgtttactacctaccgaagtgataaacatatctattgggaaatcccggattcattgattggacgtgagtttgccgtaacgacaactatcctgacagctcctgcccgtccggaccgggatatggaaaagaaattcggatatgcgggtgacatgataggtccggtatttttcagtttccgtaaacagggtgacgagttgtggatgatggatccacaatatgagagggtgatagaaaatcctgaaggaacgtatgcaaaaatcgccgcccaacgtgggaacgaaaggctttataagatattaccgattaaagctaggaatcagggaagcagcttgatagagattggtgaagtattaaaagattttcctttgtttactcttgatattgtatcttttgatttattgataggtacgcgtttaagagagaaagattatatcaaggaaattaaaggatatgacaaccgcttgttgatacacgcatcacgagtttatcgaagttcgtcaatgaaaataccaggtaagcctgttgcacctccttatattggagactgggatacaggtatctgcataaaattactgtcaaaaagaccgttggaggcagttgctgcaaataccggagcttatttttctatcagcaaggagtgttttcaagggaatcagcctgctattcggaaatctgttgtcaaacgatggcggctggaaataagggcggaagatgaagaaagatacatgaggggggaactggtagaacccatacaacctattattttttatatagatcgtaatacaccggaaaagtacatcgactgtatcattgaagcggtgcgtgactggcgtccggctttcgagaaagctggatttaagaacgccattgatgcgcgactggctcctaccgttgaggaagatcctgattttagtatttatgacagtacttatccgttcatctcatggaagatatcaggacaaaataacgcttatggaccgactccatgcgaaccccggtccggtgagattatagcttgccacatcggtattttttgcagtgtcttgaatttggaacagaaatggtattttgctcaatgtggagcgaatgatccgcaggcatggaatatagagttgccggactctttgcaatacgaacagataaaacaagtattgacacatgaagtgggtcatacattagggttggaacataactttctgggtagttctcattactccatcgatcaattacgtgataatgactttttaagtcaatatagtattggtagttccataatggattatgtgcggtgtaattatgctttgcatcctcaagataaagttgatttgagaaacaggcgggtacgtgtcggcgaatatgataagtgggctattgaatggggctaccgtatatttccgggtaaagatgcttctgaaagagaaaagaacaggagcctttggaatcaggaaaaacagaaagatccctcgttacatttttcgggcagaatggatgtaagggctcaggcagaagatttgggtaatgaccatgttatggttaatacacagggaatagagaacttgaaatatttgtgtgaacatccggatgtctggaatgtgacggataaaacgtctttgcgtgtattacaggggcgttatgaagcggtattggagcattataaacagtgggtacagcacgttttgtctcatttgggcgggaaacgtcttgctgagccggatgatgagaatatttacatacctgaaaaagccgattacaataagaaggttatgagctttatacaggcttatatattacaaccgcctgtgtggatgtttgatgaaaaacttaccgctaaattagaaataaatggtagtcgggagttcgatcgcttttatgaagagctgatgtcggaaatgattcgttccctccgggaagtggaaagaacggagaatgtttgtgaggatatgttgtctgtagatgagtttttggaaagcatacataaagaattatttaccgaatgggctgacaatattcctgtaagtgacgccaagtataaagtgcagctgctttatgtgagtaaacttgttaaattgttggatagatcagaaaagataacttcgtcgagattattggtttccatcatgcaggctttgaatagaataaaggaggaaagtcttgattatagccataagattacggatccggttgccaaaaaacgggcaatgtttcttgtagatagtattttgttttaatgatgaaaagtaaataaagaaattcatgaagagaagaagatatgtgattggtatattgttgtgtgtcacagctttgcttcaggcacaggattccgtcaagtcatttgacgagttttttgttgccgggatggataagatcgacggtgtgtttcctgtgtatgtagcggaaaaagaaatctatttggaaatacccgaaaaatatatcgggcgggaaattgaagtcagtggacagatagaccgagggtttgatttgttgaatcgtccggttgacggactgggagtagtgcgtattatatctccggataaagctacaatttgctttcaaaaaccgttttatacagagcgtattttagatgaaaaaagcacatatcagcaatctttctcgttgtcaaatatgcaacctgccggtaaaagttatccagtggtggcctattcaaaagagcagggagctattattcggataacagagtatctgatgactggcgatgactggttcagctataatgatagttttattcgttccttggttccggaactgtcggaaataatgaaaatacatccttttaaggaaggtgtgtcgtttacggtcaggcgctatcatggagttgaagcggaaagatatatgctgtccagttctgccattatattgcctgaaggtagtatgcctttggaagtcacttgtgcagtacgcttgctacctctgaaaaaagatcagatccgcttggcagattacagaataccttaccggacattgagtttcaaagattactcgcaaaatccttattgtatggtagaagattcattgattcttcgttgggatatgtcacaaccgcttactttctatgtagacactctttttccgaaggaatacttccaggcagtaaaggaaggagtggaagcatggaataccgccttccataaagctggtattcatgatgctttacaagtaaggtatgcagaccgaaagataattccggcggaacaacgtgcttttatatcttatgatttgagaataccggggattaaaagtgactttatctgtcatcctcgtaccggagaaatactttcatgtcgtctgaatatcggacatggattcctaaaaggaaaattagacgactatctgttaagttgcggtgcctcggattcgcgtattttggctgaccgttattctaaagaagtggaaaaagaattgttgcaaaatgaaataacggaagaaattggatatcttttaggtttgcgcagaagtttatcgaaaagttcgtgtggaaagactttaaaagttggagatgatgattgccgtactatttattttggttatcatcctttcaaaggagaccaaaattgttatgatgaacgggagaagctccgccaatggatagagcataatttaccagatcacattcgtttattccaaccatcagggaaggagaattctaattcttcatttccagaagattatacggtcaaaatatcggatttacagactgtagtgagtcggttggacaagattgtgtataaggggaagaaatacgataaagggagttcgctcactgatatatacagaaaggctattcgtctgtatgggagttatctgatggaaatggcaaaggtggtgggtagttctcaaccggcagatgcacagcgtcaggcaatgcttgatttggacaactatttatttcattctgttaaaaagatagaatgtacctatgtaaaagagaatttgttggaaacaagaaacaatcttctgtatccggaactgacgaggttgttcaaacaattgttgagtgtaaagacaatttcagctcttcgattgcaggcgttgcagagtgaccggaaggggtatgacgatattgattttttccgggatctttataaggggttgtttaatggttttgatccgcagtcagccgttagttatgaacagatggatattcagctgatatgtttggaagcatggctggatattatgcaggaagctactgaacataatagtataaagaaacgtttgacgaacgaattgcatagtctgcacgatagactggaggagcttagcacgacacattcccaaagggaagtacgtgatatgtatattctgcttttgagaagaatggagcaatatttccgtgtggtttcttgagtggcgttagagtaataatttgtttgggatgatgaaaaaatggtcgtacagatagaataacctataagttttgggttatctttgctatgatttatgaataaataattagaataagatgactattatttttccttcacccatcttcggccctattcattcccgtcgtttgggcgtttcattgggaatcaatttattgccggacgacggtaaggtttgttcattcgactgcatttattgtgagtgtggtttcaatgccgaacatcgtacgaagaaacttcttcctacccgtgaagaagtccgcacggctctcgaagagaaactaaaagacatgcaggcaaacggccctgctcccgatgtactgacatttgccggaaatggtgaaccgactgcgcatccccatttcccggaaatcatagaagatacacttgcgcttcgcgacaggtatttcccaaaagcgaaagtaagcgtattgagtaactctacatttattgatcgccctgccgtattcgaagcactgaacaagatagataataatatcctgaaactggatacagtggatgaagaatatattcatctgttggaccgtcctaacggaaaatattctgttaagaagatcatcgaaagaatgaaagagttcaaaggaaactgcatcgtacagacgatgttcctgaaaggaggttatcagggaaaagacatggataatacatccgacaagtatgtgctcccctggatagaagcagtgaaagaaatcgctccccgtcaagtgatgatatatacgattgaccgggagactcccgaccacgatttgcaaaaggctacgcatgaagagttagaccgtattgtggctttattggaaaaagagggtattccggcaacagcttcttattaaaatataattcaaacagggatatatttcttcttgataatacgtaagagagttaatataagagggcgaactaatagaattcagaagttttatacttcctattctattgctcgcctttttattggcttcatgagctgtttcagcctattctgacaagggtatattctcacttcgatgagaaaaagttctcattgtagtgagagttttttctcattacaatgagtattttttctcatcgaagtgagaatgcttgagaatgtgtacttccctgataatgtttcctttcttcacataatctttcggcaatatcccgaactgcttctgaaagcaacgggcaaagtacgaaggattattgaatcctacaatgaaacaaacctcattgatccggtatttacgccaagtgttatctgcaaaacgttctttataaagaacactccttccagattaaagggcttatttacctaattatgtttcctgtaaatactcattttaccgaaacatagttaggtaaacaaaataaagttcttatatttgcatgaattgaaggttattaaaaactgattttggtatggaaaagaccctgatacgccagaatgcccaatggaatggcaaaatgtttgatcacttgtgtccgagagacatcatggacaatcttctgaaaaagaaaacgatgcgtcatgtccagatactgactggtgtacgtcgttgtggcaaatctactgtcttcaaactattaattaatgacctcttgcaatcaggagtgagcggtaagtcgattcttgtacttaatttggatgatccgcagttcattccattttgggatgattcttccaaattattcagcgtaattgaaaatgcagaacgtctgacgggagagaaagtgaaatacctgtttttggatgaagtacaacatttatgtgattgggagatattcataaagagtgcttatgacactgagatatttgaaaagatatatattacggggtctaactcgcaattattacagaaccgtttttccgccttgttgtccggtcgttatttcgagaatgaagtgcgtccgttttctgttcgggaagtttttcgttcgcaaggaataacgactttgcttgattgttatacccaaacaccgaaagttctgcgtatcatggacaatgtcctttctacaggttgttttcctgaaatcgtattgggtgatgctgatgaggacatcaaacaggaattattgaaaagctatttcgaatccattgtgcagaaggattgcatcgtttatagtggcatacgtgacacccatttgttctttcgtctggtcagttacttgatgcagaatatggggagccgtttttctataccggctgtgggtaaggcactgaaaagcaatgaaaatacagttgcgtcctatctcaactttttgtgtgacagttatatttgcgtcgatgtacgtaacttttcttattctttgaaagagacttcccgttcccagcataagtgttatttcattgacaatggcttggtttcagccaatgtctttcgttattctccgcagagtggtagtgccttggagaatcttgtttataatgagctgagaaataaagggtatatgaatatttcattcgacaatagtaagacggaatgtgattttttggcatataaaaacgggaaagcttatggctttcaggtttgctatgaactgaatgacatgaacttgaaacgtgaactgtacggattcgaacaggaaaatgtgatgctcgaaaagaagatactgcttacttacaaccagaaggaaacttatggggatattgaagttgttcccttttgggaatgggttatgtcaccacctttcacataatctttcggcaatattccgaactgtttctgaaagcaacgggcgaagtacgaaggattattgaatcctacaatgaaacagacctcattaatccggtactccccttcccgcaaaagttctcccgcagttttgagccgaatcaaccggatatagtcattgggcggcattccggtcagtcctttcaatttgcgttgtaagttggaacggctgatagccatctcctctgccatcttgtcgatggtaaattcttcattggtgaaattgcgggtaatgatttcattgatcgtgttcagccatttcacgtctgttttgttcattaatgtctggtcgtatgacatattcggaacggttgtaaagtggttgaacagcatgcgccggttttccagcagattattgatagtggctttcatgtggcttagcgagaaaggcttttctatataagcgtccgcgccatagtcaagacccgcaatttttgaatcgatgctgtcgagtgccgaaagcaggataaacgggatatggcaaagcatattgtcggaacggatggactttaataattcgaatccgtccatgtgaggcatgacgatgtcgctgataataagatctactgtcgttgtctccagacattccaacgcttccttgccattggcggctgtatggatggtataggtatttcccagattcttagccagaaactccagcatatccgtcgtgtcttctactactaaaagagagtaaccggcgggttcgccttcttcttccagagcgggaaccttgtcgggcatggaagtaatggaggggctgacagagatgcttttctccaaatacggaatttccacacatacctcgcatccttccgtataaccgggattgatataaacctttcctttatgcttttccaccaacaatttgacgagactcaatccgattcctactcccgaaccgttgtttcctgtgtttcccacttgataaaacggttcgaaaaccttgctgcattcctcttgcggaatacccggaccgtcgtcgcgtacacacaaggagagcgtacgcccttctgcagacagatgttcgtccaaaatcaccataatgcgggtgcgggcatatttcatggcatttgtcagcaggttgctgacaattttagtcagcgcctcctggtctacattatattgcagatgttctttcggcagggagacactgaaagagattccggtcagggagatggcacggaaacggtcgatgatgtcctctatcatccggttgatatccacttcattgaatgaaagcgtataaccttccttgtccactttgcggaagtcgagcaattgtttgataagctccatcagccggttggtattcttttgtatcacagacaggttgctttccacttcactgttccattcatgtgtttccaaaatcgcttccagcggagctttgataagactaaccggagtcttgatttcatgtgccacttgggtgaagaatgtaattttcgactggaacaattcctgattcttgatttgttccatctctttcatctttcttgctttcacagcctgctgtttacgcaaataaagctgtatcaggaaatatgcgaggccacacgctattagtaaatagaaaatcttggcataaatggtcttccagggtggaggaagaatttcaatatgcaggcaacagtcgtcattgctccaatattcatcgttgttactggctttcacacggaaagtatattcacccggaggcaggttgagaaaagatacgttatgtttatccgtatatatccattctttgtgaataccgtccagtttgtaggcatataaattcttgctgggagccacataactaagactttcgaatgcgatgtcgaacgataccacctgataaggaatcgttacttgtccgctaagagcaggtatacgcttgctaaggcttactttgtcgtcggggctgtgcatatataccgccgagatagacgccgtaggtcttaccttattaatcgataatttgaacggatagaaactattgaacccgttcactccaccgaaatagaatttcccgtcactggcttgcagggaagagcggaaattgaactggttgctttgtaatccgtcctcgatggtatagagctgtgcccgtttgttctgcggctcataccggatcagtcccctattggaagaaagccaatagttacccgattggtcgtccagtatgccatagatgatattgtttggcagattctctttggtagagaagttttcaaaacggtcctcctgatagtgataacggcagataccaccgccttcggtacagaaccatagatgctgtttatgatcaatatacacacggattacccagttgctgcaaggagaatcaggatttgccgggtcgttgcgatagttgtgcaatttaccggtttggcggttgtaacgccaaatgccgtcccttttgcttgccagccacatgtccccatgttggtcttcaaccatatcgtagataaagatatggcttaaaggttccaatgttcggaaagagtcactttccgggtcataccggcagaatccggaaagcgttcccagataaatgctgccatccttcgtttgatagatggagtagatatggtcgttaggaattgaatgtgggtttgcgcggttatggcgatagtttttcatttttcccgtttgagtatccaggatatataatccccgtgagaaactgccaatccacaattttccttcattgtatagtagtgcatggatattgtgataaccgatgttagggttactgcttctcaacagatggtttttgaactttttcgtgcggggatcaaagagattcagccccccgtcttcggtagcaatccagatgttaccgtcgggatcttcgcagaattggctgattacatttcccgaaagagaattttccgtaccattgggataataccactcgatatccttatgcttgggagacaggtaactcactccactgaaataagtcccgatccagattcccccttccctatcctgataacaggcatagatactttctttattttgttcgtcgtcggtaggcagacattctcctgtcgtggtgttgaatgtataaagtccgtcgtcggagccgagatagaaagagttggctgttcgttgaaacaaggtgcggatgcgcggaatggtaagcgtgtccccttctccgaagtaatagcggaattgccctgtctccttattgaaacgtgccagtcccccgtaccatgtacccgcccataatactccctgcgaactttccatcaaagagataatctcgttgcaggcaggacgtccgaaagaagtgccctcggatatatatcctgtgaagttgtccgtacgttggttgtatttcgccagcccattccgggtacctatccagatagtcccgaacgagtcgttataaatcacccatatgtgattatccggcagtgaatgaggatcggaaagagaatgcagatagtgcctcaacgtaccttttttctcgttgtagacaaacagcccgttggttgttccgatccataactgcccgtcattgtcgtatgccattccgaagacactgttgactgtcactccgtcttccgtctgtgtatcgaatacggagaatttctcctcccgcgaatcgaataaatacagtttttccgtactggccacccaaatctgattgttatcctgatggcggcagatagttactatattcatataactgtttccaccgttttctgacgaatgtccgtagttggtgaactcgataccgttgaaacgattcagcccgtcctgcgttgcaaaccacatatatccgatgctatcctgaaggatgctccggacacaattgcccgataaccccgatctaacgtcatatttcttgtagatattggcgaagaccagagaaacggatgccagcagtatacatatagataagatggatcgtttcataatttcctttctttatatcccctgtttgcaggagctatatatcctgcgtattggatctatatgtccaatacgttggatctatatgcccaacagattggatatatagctcctgtaaacagggtaattatcccctttatagaagcctttatttcacgtcatcccacgtatctgtgcggaacgggaaagcactcaatccgaaagtattccgcagcgtgatatttcccacataattgcggaaagcatagcgcacggcaaccggttgggctacatcttcactccacacttctactgtgttggtacgtcctacaatctttgctttcgccggatagaacttcttgtccgctcccgcaatctcgaatccttccagttcggagaaagtagggaacaatcccgcaggtgcgttatcgaatgtcactatggcctttttgtccgcatagtccactttagtcatcgtcggaccgttggatggcaatcggcgaataccgtatgttttagtcagtgcaagcgtagccaaccgaagccctactacatccttctgtggcggatggatacagaattcatcaccaatatccgtagtaggcaccatgcccgaattaggaattgttttcagtgcttccatctgtgcttcccgcaatagagcggcccctgtatcacggctgtccttatatttatgaggagcaatctgcacataatagaaaggcatatcgggagcctcccatacatttctccatagctgcaccatagcagtcatcatcggagcatagaattgatagttggatatattcgattctccctgataccaaaggaaaccgcgtgccgtgaagttcttaacaggccataacatcgagttgtacagacattccaaacgctggtgcacccctcttttaggatttttggcagcttcaatgttcataccttccacggttttcaatgtcggttcatccatccatgcttcaatcgccgaacctccccaactgttgataaccagtcctaccgggagatggagactttcagtcagttggcgggcaaagaaataggcggcggcactgcaatcaatgctcgtttcgggtgacgatacttcccattttcttttctcgaaatccgtgcggcgttctgtatcattggttctcggtacggtaataaaacgaatacggtcgcgataatttcccgagttcagcagcgtttcaagtgagtggtcaatgggttgtgctgcatttcccatcatacgcatttccatgttcgactgtccggagcagatccacacctcccctatcagtatatccgagagagtgaccggagtgccgtcactgatcgtaatagaataaggagtatatcctccttcgggagtgtctactttcaccagccaggccccgtctttatccgtagatgcctgataagtccggttgttccacgaagtggtgacaattacttttttgccgtccgcccacccccataacttaacggagctattctgttgaagtaccatgtgatctcccatcattgcagggagttttactttgccttgtgcaatcggcaggaataaaagtgataaaataagaagtagaaaatgttttttcatactgtttttattagatattcgacgaataattattaggtatcaggcaaaaatacaacctatttttaaatatggaataaaactagctagtcattttctgataaaagctggtcgaaatcttaaaagcttgtttttcctttccattctccgccgaattttcttaattagtggcatcaatcgcctaaacagtattattagattggctaaatatcccatttctttgcagggtgagtatttaacaacctaattgtttcattaaatctaataaaatgaaaaagaagcattatctattatttttattggcttcgctctttttactgacagatgtggtgtgggcacaaacatctgccacggtaaatggagtagtgatcgatgagaatggagaaaccctgccgggtgtttccgtcgtcgaagtaggtacaacaaacggtgtcctgacagacctgaacggacactacaccttaaaaacaacttctgccaaaccttccgtttctttcagttacattggttatcagaccaccacgcttcccctgaacggacgtacgaaactcgatgtacagatgaaagtggaaacgaaagtactggatgaagtagtggtagtgggctacggtgtacagaagaaagtgaacctgaccggttctgtgacttccatcaactttgccgaccagacggaaggacgacccatcatgagtgtttcttccgccctttcgggactcgccgccggtatgaacgtcacacaagcttcgggacaacccggctcggacggtgccaccatccgcgtgcgtggtaacggtacgttcaataccaactccccattggtcctggtggacggtatcgaatggagcatggacaatgtgaaccccaacgacatcgaaagcatctccgtactgaaagacgctgcctccacagctatttatggtacgcgcgccgccaacggagtcatccttatcaccaccaaaaacgggaaaggcaaaccgcaaatctcctattcttattcgggagttgtgcagatgccttacaataacctctctttcgtgagcgactatgcccgctatatgggactggtgaacgaggcttgcgacaatgtgaataccaaaggcatcttctcgcaggaaagcattgaccgctggagggctgcttctgccgatccgaacgggttgaacgagcacggagtacccaattacgtggcttatcccaacaccgattggttcgacgaagtattcgacaccggatattcgcaagagcacaacctgtctgtctccggcagttcggagaaagtgaaatacatgctttcattgggctatcttgacaatcagggagtcatgaaccgctggaacctcgactcaagtacgcagaaaatcaatttccgtaccaacctggaagccaagatagtgaaatggatgactgtcggcacccgtctctacggacaaaagcaagattacgggatggctaatatcagcaacggattcaagtatctctatcagaccactccgggtgtataccccggcgaaccgaactactggggacgtgccgcactggccagcgaagaatcttccaatgccaataatatcttcggtcagatggcaggagccaccggtttcaataccgtctggcgtctcaacgcatcagtctacggaattatcactccctataaagggctcaacattgaaggtacattcaactattcgccgacattcaccgacaagtcttcttatagccgccaaaatggttattgggactacgtcaccgaccagcgtgtcagtgaaagcgcgttggagaacgcttccatcaccaatacgagtgcacgcacctggcgtcagagtgccgaaatactggtacgctacaatacaactatcaagaaagaccacgacctgggcgcactgttcggatattccgcacaggaatattacagcaagagctttgccgtttcccgtaaaggcgctacggactggacgctgaacgaattaagcacttacgagacgctcgtcagctcttccagctcggcacccgccaaatggggattgctctcttatttcggccgtgtcaactacggatataaaggacgttatctcttcgaagccaaccttcgtgccgatgcctcctcccgtttcggtgtgaaccagcgttggggatatttcccctcgttctccggcggatggcgtatctcagaagaatcattcatgcagggagcatcggactgtctctctaacctgaaactgcgtgtttcctggggaaagacaggtaacaactcaacgggcaactacgactggcaggcaaactacgccacaggcaatgtcgtaatcgacggtgaaggaaccaaaggactggtacgcaagaaactaagcaacgacaagctgcattgggaaagtaccgctaccaccgacatcggacttgatttcggcttcttcaacaaccgcctgacgggtgagatagactattataataagtatacttcggacattctctaccatcccgaactctatctttcgatgggtgttgtaggctctgctcccgagaatctgggtgaagtgcgcaaccgtggtgttgaatttaccctcaactggaacgaccgcatcggaaaagatttcgaataccgggtgggtatgaacttctctttcaacgccaataaagtaatgaagttcaaaggcgaactccagaaatactggacgtatgatgcgcagggaaacaaagtgagctatgtcaataactttagtgatgtgtctgaatccggtttcggaggttacatctgcgaaggccgccaacttggggaaacctatatgtataaggtgtacagaggttccggcgaaggctataccggaggtgcggtggatatccatgcggggccgaaggacggaatgatacgtacgaaagaagatatggtatgggtgcaggccatgattgactccggttattcgttcggaggaatgaagacagttgccaaagaccagctttggtatggtgatatactctatgccgacagcaacggtgatatgaactacggcgataccaacgaccgggatttctccggacacaccagtgtcccgaaattcaatctgggtttcaactgtgctttctcttacaagaacattgatttctccatgttatggtcgggagctttcgggcattacctcaactggaatacggattactacaactcgacactggtcagccatggatatggcattatcgagcatatcgccgataaccattacttcttcgatccttccaacccggacgatccgcgtaccaaccagtggggcaaatatccccgcctgacatacggtactacctataataacagaatccagagcgactggaacgaatataagggcgactacttcaagttgaagaatatccagatcggctatacgttgccgcaacggatttccagcaagttctttgttaataagctccgtgctttcgtgtcgatggacaatatcctgacgatcaccagttatccgggactcgatccggaaataggaactgccatcggttatccgttgatgcgtcagatctcttttggcggacagattaccttttaatgatgtagaactaaaaaacagaatctgatatgaaaaagatattaatgattttaacgatggcgctggcggctacctcctgcatggatattctcgatgtggctccggaagaccagattgcaagtgaaaacatgtggaccacggaagagcttgccgacaagggaatggcaggactctacttcccgttctatgctacccaactctcctctacccagcttcgccgtgccgacggactgaaccgtcagggaatcgaagctatgagctttgcaaccgattattattccaacaactatccggtggaactgctttcgctggccaccaagcctgccaatgactttcaggtgtggtatgaatggaagttctgttacaccattatccatgcgtgtaacgatgcgattgccaatctgcataaagcggatatgagtgctaataaactggcgcgttaccaatgcgaagcccgtttccttcgtgcttgggcgtacaatcgtctgaatatgctttatcaaggtgtccccgtttatctggaacctatcaataacgaagactgtacccgtggccaatcttcggtggatgaggtatggcaagtgattctggatgatttgacgtattgcatcaacaatcccgacttccccaataacacgctgaatgaaaactacggccgtccttctaaaggtgccgcttatgctctgcgtggtatggtatatatgtggaagaagcaatacaaggaagcaggcaacgatttcaaagaagtggaaacgtgtggttatggcttgtggacaggcgaatatgccgacttctttaaatatgaaaacgaaaaggataaagaaatgatcttctcgctccagttcagcgaagaaaccggttattgtgataacattcagcaaatgaccggtgcccgcgatacgtatgatggctggacggaaataaaaccttccgcagactttgtagattactataagaatgcagacggatcggacttcaaatggtcggaagtagacggcctgcaagactgggacttgctgactccgaaacagcgtgaaatcttcttctgccgtgacggactggaatccatgtcctcacaaaagaatgcgcttatcaaacgggtaggcgaagatatctatcagaaatattacctgaacagcggtaatgaagcccgcatcaaaaaggcgtatgacagtcgtgacccgcgtctgcaacagaccgtcgtcactccttatgtggcagtggactgctacaaacctaattatgcaggagatgccaaccaaatcggtaaacaactccgttggccgttgaaggaacagggcacgaatggtggagacttctggctcgataaacgtacttctgctttctactgctatcgcaagtacaatgagtttgagaaaggccgtttgattagccggagccgttgccataccgactggccgttgattcgctataccgatgtactgttgcagtatgccgaagcattggcgcagaccgatcagttgggagaagccatccgcctggtgaataaagtgcgtacccgtgcccacatgcctgcactgacagagggcggaagcggcccgtgcgcagtgaacggaaaggaagacatgctcgaaaggatacgttatgaacgtcgcgtggaattctgtctggaaggaatcaacttcttcgatgaagtacgttggggaacctacaaagaaaccaaattccaggggaaagacgtgaatggcggcaagtcctggtggggcgatatggtagagtataactggtattacaccgattacatgtggccgtggactgctcctatctctgaaacgcaaaagaacccgaacctgactaaacgaagcggttgggcgtattaatcataaagatttgaataaggatgaagaaaatacttttactattactcatttttgtatccggttgcacgggtgtagttgcgcaacagtttgattatggcaagatagcgcctcatccccggttgttattgccggcgggaggagaagaagccatcaggaaagccattgcggagtatcccccgttggccactgttcaccaacggattatggaactttgcgaccggacacttacggaaccacctgtggaacgtatcaaggagggcaaacgcctgctggcgatttcgcgcatcgcattgaagcgtatctattacctctcatacgcttatcgtatgacgggagatcagaaatacgctctccgtgcggaacaggagatgctggccgttagtcatttcaccgactggaaccctactcatttcctggatgtgggtgagatggtaatggcattggctatcggttatgactggctgtatgactctttgcagcccgacacccgccgggtggtgcgcgaagcaatcatcgcgaaagggttcgacgcggcaaagaacacccgtcatgcctggttctatacagccaagaataactggaattccgtatgtaatagtggattggcgtatggcgcgctggctctttttgaagagattccggaggtatcgaaaggcatcatagagaaatgcatggagacaaatccgaaagcgatggtaggttatggccccgacggaggttatcccgaagggttcggatattgggggtacgggacaagttttcaggtaatgctcattgctgcgctcgaaagtgctttcggcacagacaatgggctctcccaagcccccggcttcatggaatctgcccgtttcatgcagtatatgacagctccgagcggagactgtttctgtttctcggactctccggtggaggcagagtgtaatatgatgatgttctggtttgcaggcaaggcgaaagacctttccctgttgtggatcgaacgtcagtatctcgaccgcccggatatgcagtttgccgaagaccgtttactgcccagcctgatggtgttctgttcacagctcgacctgaaccggatcggaaagccgaagaaaaacttctggtttaaccgtggagatacgcctgtgtttatctaccgtggcggatgggacagcaagaaagatacctatctgggagtgaaaggaggttcgccctctacctctcatgcacacatggatgccgggtcgtttatcttcgagagagacggagtgcgttgggcgatggacttggggatgcagagttatatcacactcgaaagtaagggagtggacctgtggaatatgtcgcagaacggacaacgctgggaagtattccggctaagcaatattgctcacaatacgttgacgattaacggagaacgccatttggtagagagcaatgccccgatcatccgtactttcgagtcgaagaaacagaaaggggcggaagtggacctgtcgagtgtgtttgccaacagcgtgaagaaagccgtccgcaccgtgatattggatcagaaagaccatctggaagtgaccgaccggttgcagacgggagacaaagaagctgccgtatcctggatcatggtcactccggcagaagccaaaattacaggcaagaaccggatggaattaaccaaagacggacaacggatgctattgacggtagatgccgatacggaagtagaaatgaaaacctggtcgaacgtgcccccgcatgaatatgatttccgcaatccgggaaccatccgcgtgggctttgagacggtgattcctgccaatcgtgccgtgcaactgaaagtacgacttattcctttgaagtagtaatacaaataaattcattgaaccatgaaaacgattctttttaaaacaatcatcatagctttctttgtaggaacagccgttagttgttccgatgaagatgagaacagattccgtccgggatctacccatgagaaaccgaatcccacggagccggagggcggattggattattccaaactgaccgcggacaatcatccccgcctgttgatgaacgccgaggccttcactgcgttgaaagccaaagtggatgctaattcgagtgccaatctgaccttgctccataataccattatgggggtatgcaacagcaaagggatgaacgccacggcactgacttataaattggatgccagcaacaaacgtattctcgatgtatcccgcgatgcgttactgcgtattttcacctgtgcttatgcctaccggatgaccggcgatgccaaatacctgactaaagcggaaacggatatgaacgctgtctgcaactttcccgactggaactcgaaacgccactttctcgatgtgggcgaaatggctacggctgttgcgttcggctacgattggctctacaacgaactaagcgcagccacccgtacaaaagcggccaacgcactgttgaagtttgccttccaacaggcacagaacaagaactggaacctcaacttctacgaagccaccaacaactggaaccaggtttgtaatggcggactggtctgtgcggcactggcttcttatgaaaacaatccttccgaagcaaaggacatgattgaaaaggcattggaatccaacaaacctgcattggaagtgatgtactctcccgacggcaactatccggagggcagcggttactggtgttacggcacgctctatcaggtattgatgcttgccgccctcaacagtacgctcggcacggataacgggctttccgatacaccgggattctctaaaacggcagaatatatgctgtatatgacaggcttgaacagcaagttctttaattattccgactgtgccccctcctctactgcggcattggcttcgtggtggtttgccgataaatacagtaatccatccttattatataatgaactgaaaatgctgaagaacggtgaatacgcttcctgtgccgaaaaccgcctgttaccgatgattatggcgtttgccaataatctgaatctggacgcaatctccgctccttccaataaattatggagtggaaaaggggaaacgcccgtagtgatggtacataccgactggacgtacactgatacggataaatacctcggaatcaaaggtggcaaggcaggttcgagccacggacacatggatgccggttcgtttgtgtacgacgcgtatggagtgcgctggtcgatggatttcggtctgcaaagttatacaacgctcgagtcgaaattgtcagctttgggtggtaatctttgggatatgggacagaactcgatgcgttgggatgtattccgcctgaataacttgaatcatagcacgatttcaatcaacgacgcccgtcaccgggtaaatggggtggctacactgactactaccatcaataccgctacggaattgggagccactttcgatctgactgaagtagtgtccgatcaggcggcgtccgctacccgtaccgtgaaaatcgtgaacgataaagatttagtagtcatggatgagatcaaggcgagaacagataaatccgctaaagtgcgctggtgtatggtaacgcctgccgttccgacggtggaaagtaaccgcatcgtactaacgaacggaagcaaagtgatgtatctcacagccagcggaagcgtgaagcctacctacaagcaatggagtactaccagcgagaactcttatgaccaggctaatccgggcacctatatggtcggctttgaagcaacggtcaccgccaatcagaccgccacatttaccacaaccctgtcccctaaataaaaaagaatggaacgtatgagaatcctattaatatctatactcggacttttgacattggcctcctgcacgaagcaggagccgatggaggcgttgattgaccgtgtatttaccgttgcggagcaacaatacacggctatggacacccgcctgacagaaaagacacttccccgcacgctctctgccgacggtgagtttgttccctcgaatatctattggtggtgtagcggcttctatcccggttccctctggtatatctacgaatatacccggaaggatgcagtgaaaacactggccgagaagaacacgctgaaactcgactctatacaatacgtgaccagggatcacgatgtcggtttccagttgaattgcagttacggcaatgctttccggctgacaggtaatgaggcttataaacaagtgctctatcagggtgccaaatccttgtcaacccgcttcaatcctgctgccggtgtgatccgtagctgggactttgtacgcaaaggctgcgactggaagtttccggtgattattgacaatatgatgaaccttgaattgctgttgtccatgtcgaaagcctacgccgacgactctttgcagaacattgcctgtacgcatgccaataccactatccagcatcacttccgggatgattattccacctatcatctggtggattatgatcctgaaacgggtgcggtgcgcggcaagcaaacggtgcagggcttctcggacgactcctcctggagccgcggacaagcatgggctttgtatagttatacgatgatgttccgtctgacgggatatcagaattatctgttgcaagctgggcatatcgctgatatgctgcttcgccgtttgccggccgatggtattccttactgggatttcgacgctccggtagaagagcagacctatcgggatgcttccgctgcggctatcatggcctccgcctttatcgaactaagccgttatatccccggcacggaagccaaggaatcttatcttgccatggcagaaaagcaactccgtacgcttgcctcgaaagagtatctggcagaaccgggtacaaacgaatgttttatcctgaagcacagcgtgggtgcacttcctgataaaagcgaagtagatgtccccctgacgtatgccgattattactttttagaagcattgctacggtataagaatctacaaaaataaaactaatacaatatgattatgaagaacttacatataagcatggcatttatcttcgtattactgctgataactgcctcctgttcggacaaggatgattcggctccacgtgtcatccccaccatgaacctaacagtttcggagattgcagacaatacggctctgattacttccgaacagcaaacaggtactacattcggagcgaaagtcattgaattctatccggtggccgatatcggttttgattataacattgaagtgaagctggtgaaattcgtagaagagaacggagaacccgtatctctgccctatacgcgcaaaatcaccgaaggattgcgtccgggagtgaattacatcagtgcgatcatcgcctataatgccgaaggacgtgccgtgtgttccgctttccagacctggaaagcttcaggaacggaaggagcatggagtgacggcggttctgccggtgatctggaagagaatgaatggtaaaaatggtgtaactcaaaagaatgaatggtatgaaaaatagattatttgcaataggtgcaatgattcttatgatgacaagttgcacgcaggacgaacttatttcgtccgataagggcaaagaaccggcaacggcaggttcatgtctgacattggttggactctcgtctccgcagacgcgtgtttctatcggtgacaaaacaggggacgtttatccggtgctctggagcgaaggggatgccttgggtgtgttctctcgtacggcagggaccgacatcaataatgtgcagtctttattaagtgatgagtcgatcgggcaaaactccggtgtctttacttcggacgacgtgaagatggcggaagaaggagctacggaacttcttatttactatccttaccgggcaagtacggaactggccgaaaatggcaacaagataacttctaccctgtctgttgagcaggaacaaagccgtcccggcgatagccgtcatattggaaagtatggttttgcgtttgccaaggctacggtcagcagtccggatatgcttgctaagtttacgttgaaccatgcgatggcgtatgtgaagttcagtatctcgtcccaggagctttctacgtacaaactcaagagtgtctctttatatgacaaggagacaaaaactcctctttccggtgtattcacagcagatttggatacggacgaactgacctacggtacggatgtgaaaccgtatgccactgtttcactgactactcccgaactgctcgcttccgcacaggatatatacctgactacgtatcctgctgatttgagcggcaaagaagtgtacattgtcatcactctggagaatgaccagcagactgttacaattcctattctcaaagaaggaaagcaactgaaagccaatgctgtcaatacgattgctgtcaacaacctgaaactttcggataattcctgcgaatggtacgagccggtagagacacgtctgctggcaggaggatgggcttatggcgagtccaactgtctgttgacgaatatttctaccagtggcgtgagcaatacgatgagtgtgaaagcacgtggtaactttatggaagtggaagaacccaagtatgccaaaactattctgggttgcgatttgaacgttaatcataagatgattgccgtgaatggctctactacggacatctctcctattggcagtgattacaatattacgatcaacacctataaagtaagtggaggctatgacggcggttgcggtcaggtggctatctatggagcggatcagactaccgtcatctggagttttattatctggatgacccctactccggcagaacacccttatggtaatacgggatatgtagtgttggatcgtaatctgggtacttatatgacgtgcgaaggagacaactggaagcaaaacggtgtttacttccaatggggacgtcctacgccggtcggctggtcgggaaccgtgggtactaatatacctaccgaagccaccaacgtccgattctctatagaaaatccccgtgcattgctttataccaataatgtagagaatacaaaatccgactggtatctgggcgcatggaccggtgcacgtaccgatcgtaaagatgacttctggggtaacccgaatgaatcgagcacttatctcaatccttctgacggtcataaatctatttatgatccttgtccgaaaggttaccgggttgtatctccccgcgtattggatgagatagaacagaaaggtgaatttgtgaaacagagcgcaactgcggtatttaaatattgctatgacggtacgaattacgcatattggccgttggcaggttgtaagtggggttccaacggcggtaataatggcaacaatacaggattggataccgctaagggggccgcttgttattggtctaactcatcggcaagcagttatggaaatgacaaggatcagggagctacttctctgtattataaagtctccgataagacttggacacattcctccggtcgttcccatgcgttctccgtgcgttgtatgaaggatgccgagaatcgttgattctcttcgttgattctcttcattgagaatatgaaatagaattccccgctatatgaaagtttctgcctgtctccggatacaaggaactttcatataacggggaatctgttctgtttttaagatattcacgaaaaaaggaaagaaagaaaagagccaaacagaaaataaactgcatgaacaattgcaagaatatacattatatctctctattttgtatttatttccttgaaatatgcacgatatggtgtaattaaacgctctgtttgccgtaatcaaaccctctgtttggtttaaacaaaccgtccgtttgctataatcaaacccttcgtttcttttaaaggaagctaaacttggtttttgaagaggatatattgagctactttgtctttttctattgtttctttataaatagcaatctgatgcatctcttgtgaaatgatagctgtttgtgcttttgaatggctacttttattgcaacttgtttgctaatagtacctatctggtgttatttgcgaaatctgtaactctaaatggagggcgtttttcatgaagtgcaaggaaacggctcgaatgatgaagagcaggacagataaaatatacaattcttcatgttggcacttttttcagcgatcaatgtctttcctctataagtatgtatctctcttaaatcaccatatatggtgaaaagcatgatagtatgcttttatactatgctatttatgcgtaaattcactgtatatggtgaattagcttgtttttctactaaaaagattctatctttgtgagaaagtcactatatatggtgaattatggatttaatagagataggaaaacatattcgcgaaaggcgtaaagagttgggcttggatcaggctacgttggcaactcttgcaggaatagggattaacgctttggtccgcttggaacgtggaagtggtaatccccgcttcgatgtcctttttaatgtcctgaaaactttaggacttagtattcatattcaataatagacacgcatatgagtcgatctgccaaagtctatataaaaggtatttatgccggtctgttaacagaaatagatcgtgaacactattcattctgttatgatacggactattataataatccacaactcccagctgtctcactgaccatgcccaagacacagcaggaatatacctcttcctatcttttccctgtcttttttaatatgacatctgaaggggataatcgtattattcaagctagaaacctgcatattgatgaagaggatgattttggtattcttctggctactgcccatacagatacaatcggagcaataacagttaaaagaatatgataatggaaacagatactcatatttgtccctcacttttacgggagactggcggagaaagcggatactcacccaaagccttgaaacagctttttgacggagaaaatatatcttgtgaattgccttataagcattttgatgataatgtcggcattgatatcttcaataacaatagcaaacgcatatctgtttcaggagtccagattaagtattctttagttgccgatgacgggatattgcgattaaccaaagagggagaacagggcgaattcatattaaagcctgtccctaataatcttcgtaacaaggagttttgccctgccaacgaacatttgacaatgcagatagctgcgcaagtatatgggattccgacagctcctaatggattatgcttttttcaggacggaacccctgcttattttgtacgacgttttgatttgtcggagaaaggaaagttacaaaaggaggattttgcttctttagccgggcttaccaggaaaaatggaggttccgattataaatatgataatctggcttatgaagagttcgcaggaattatagataaatacagttctgtgccacaagtagataaactacgtttctttgaacttgttttattcaattttgtctattctaacggcgacgctcatttaaagaacttttctttattggaagagaaaaaaggaagattccgcctatctcctgcatacgatttattgaatactcatctccatataaacgatggtatctttgccatgagcaaaggtctgtttgttaatcctgaatcggattatttcggtgctgcatcggcggttacaggaaaaacattctattattttggtttgaaaataggcctacccgaacgtttggtaaactcttgtctggagaaatatactaaggtatatgaattaacagataaactgattgaacattctttcctttctaaagaactgaaacagcaatatagacttatgtataagtcaagaatcgggagttatcttagtgttattgagtaataatgtgcacattattactcattttttatagtaagatgagcaagactcccaaaaagatttttctaacataagaatctattctttttgtcattcttcttttctgttccgataattggccggtgatgttcccaaatgcgcttttacgtatttcccgaaaaaggactgattggggaagttgaattcttccgcaatttccttgatagacttttccgaacgttttaatcggtatttgatatgctccacggcagtttcattaatcaaatccaacggagtcctgccacacgcctgtttgatgactttcgagaaatgcttcggagtgtagcaaagctcgttggcaaaataactcaccgaacggtgcatacccttgtccttcgataacagttccatgaacttccgcaaaatgtaattcacctgtttgatgccttctttcgaaccttccgtattgccggcggcttccatttccttatgaagctgccccagcatttcgcaaaagatagcagaaaagagatattgcatcacttctttgtggtagcaatgaggctcatcgtttatcttggctataattaaatcccggtagaatccgaagaaagttttatcctccccgttgccaaccgacttcaccggattgttgtggatatgaatggcagtattccacgtttccttttccattttaataatacgttgcaggaaacgggtagagaatccggcaagcctgaccttatatttaggactaagcatcgtatggctgataatcgtattgggcagaccgagcagcagctcgcccgcctgcaacttgtaggtccggtagttgacgtccagctggatgcacccttctatgcaaaccgcgatgagaaaacaattcagtttgattgtatcattactataaggagtcccctccagactgttgactatcgcaaagtcatcatctatataatcaaggacgtgctgactgtccttaaaatcctctatatccaccgtaataatgttctctttttccatgttctttccttttttactttttgcaaagttggtgaataatcgggaaaacagaatgtcccatatttcttcagatttgtttgatatgtcgtttattgccaaatagttagctataataaacgtaaatggcgagaatgggacatttatggagggaaattggtcactgttgccttgttcttttctcctacttttgtccaggatttaacaaaagaccaaaagagaaagtatgattacagtaagcaaaaaatggatacggctgatagggattgtcggttgtacagtgtggatggcatcttgcaagcaggcatcggatgcgggagtgaaatcttcttcttatgcagtaatgcagatagaagcggtggataaggaattttcttcttcctattcggcgagcatacgtgggcgacaggatattgatatttatccgcaggtgtcgggaacgattgagaaactctgtgtgaccgaagggcaaaaagtacgccgcgggcaatcgcttttcattatcgaccaagtgccttacaaggccgcactgaaaaccgccactgccaatgtggaagcagcacgtgccgcgctgggtactgccgaactgacctacaagagcaacaaagaactgtatgcgcagaaagtagtttcggaattcagtctgaaaacggccgagaattcttatctcaccgccaaagctcaactgtcgcaggccgaagcccaggagatcagtgcccgcaacaatctctcttataccgaagtgaaaagtcccagtgacggagtcgtaggtgcattgccttatcgtgcaggcgcattggtaagtgccaatatgccttatccgcttactacggtcagcgacaattcggatatgtatgtctatttctccatgaccgagaatcagttgcttgccctcacccgccagtatggcgacatggacgaagctttgaagaacatgccggaagtggaattgcgcctcaatgataattcggtttataataagaaaggtgtcatcgaatccatcagcggcgtcatcgaccggcaaacgggtactgtggtggcgcgcgtggtgtttcccaacgaatcgcggttgcttcatagcggagcctcgggcacggtggtagtgccaagcatttataaagactgtatcgccattccgcagacggccaccgtgaagatgcaggataagacgattgtatataaggtagtggacgggaaggctgtctctaccctgataacagtggccgaaaacaatgacggacgcgaatatgtggtgctggacggactgaaagcaggtgatgaaatcgtatcggaaggcgccggactggtgcgtgaaggcacgcaagttaaataagaaggagattgattatgaaaggaaatgtgtttataaaacggccggtgatggctatctccatctctgtcctgattctggccatagggcttatttcgctcttcacgctgccggtggagcaatatcctgacattgcgcctccaacggtatatgtaactgccagttatacgggtgccgatgccgaggcagtgatgaacagtgtcatcatgccactggaggagagtatcaacggtgtggaagacatgatgtatatcagttccagtgcttccaatgcaggtctggctattatacaagtttattttaagcagggcacagaccccgatatggcggcagtcaacgtgcaaaaccgtgtggctaaagcacagggattgcttccggctgaagtaacgaaagtcggcgtcagcacaatgaagcggcagaccagcttcttgcagattggcgctttggtctgcacggacggtcgatacgatcagacgttccttgccaattatctggacatcaatgtcattccccagattaaacgtatcgagggagtgggagacgtgatggagctgggcgatacatacagtatgcgtatctggctgaaaccggaacggatggcgcaatacggactggttccgtcggacattaccgccatattgggtgagcagaacatcgaagctcctaccggttcactgggcgagagttcgaagaatgttttccagtttacaatgaaatatcgcggacgcctcaaaagcgtggaagaattccggaacacggttgtccgttcgcgggaagacggttccatacttcgcctgcaagatgtggcagaggtggagttgggtacgatgacgtatagtttccgcagtgaaatggacagtcagccggccgttctttatatgatattccagacagccggttccaatgctaccgctgtcaacaaagaaatcactgcgcagatagagcggatggagaagaatctgccggcaggaacggagttcgtcacgatgatgagttccaatgacttccttttcgcttccatacacaacgtggtggagacgctgattatcgccatcattctggtcatcctcgtggtctatttcttcttgcaggatctgaagagtacgctgattccctccatctctatcattgtgtcgttggtgggtacgtttgcctgtctggtagctgcgggcttcagtctgaacatcctgacactgtttgcgctggtgcttgccatcggtacggtggtggatgatgccattgtggtggtggaggccgtgcaatccaagttcgatgccgggtataagtctccttaccttgccacgaaagatgcaatgggcgacgtgacgatggctattgtctcctgtacctgtgtatttatggctgtgtttattcctgtaaccttcatgggaggtacttcgggcgtgttttatacgcaattcggtatcacgatggcaactgccgtaggtatttcgatgatttcggctttgacgctctgtcccgctttgtgcgccatcatgatgcgtccgtcggacggaaccaagagtgccaagagcatcaacggacgggtacgtgcagcttacaatgcttcgttcaatgccgtattgggtaaatataagagaggtgtgatgttcttcatccgccatcgctggatggtgtggacttcactggctgttgccgttgccttgctggtttacctgatgagtaccactaaaacgggacttgtgccgcaggaagaccagggtgtcattatggtgaatgtcagcatttcaccgggaagcacgctcgaagaaaccacgaaagtgatggaccgcctggaaaatatcctgaaagatacgcccgaaatagaacactatgcccgcgtagcaggatacggactgatatccggtcagggaacttcgtacggtacgatgattatccgcctgaaagactggagcgaacgaaagggcaaggagcatagctcggatgctgtggtgtcccgcctcaacggacaattccagtctataaaggaagcacagatattcagcttccagcctgccatgattccgggttacggtatgggtaactccctcgaactgaaccttcaggacatgacgggtggagaactggctacgttctatgaagcggctatacagttcctcggtgctttgaacgagcgtccggaggtagcgatggcttatacatcgtatgctatcaacttcccgcagatatcggtggaagtggacgctgccaaatgcaagcgtgcgggaatttcgccgagtgcggtgctcgatgcggtgggcagttattgcggtggcgcgtatatctccaactataaccagtatggtaaagtatatcgtgtgatgatgcaggcttcgcctgaatatcgtctcgacgagcaggcgctgaataatatgtttgtacgcaatggtacgcagatggctccggtgagccagttcgtgacgctgaagcaagtgctgggaccggaaacggccaaccgtttcaatctttacagcaccatcaccgccaatgtgaatcctgccgacggttactcctccggcgaggtgcagaaagtgattgaagaagtggctgcacagtctttgccggcaggctacggctatgaatatggtggtatggcgcgcgaagaagcaagtagcggcggtgcgcagacggttttcatttacgccatctgtatcttccttatctatctgattctggcctgtctttacgagagtttcctcataccgtttgccgttatcttctccgtgccgttcgggctgatggggtcgttccttttcgccaaaatactcgggttggagaataatatctatctgcagacgggtgtgattatgttgatcggtttgctggctaagacggccattctgattacggagtacgccatagaacgtcgccgcaagggaatgggtatcgtggagtctgcctactctgccgcacaagtccgcttgcgtcctatcctgatgacggtgttgacgatgatcttcggtatgcttccgctgatgttctcctccggtgcaggtgccaatggtaacagttcgctgggtacgggcgtcgtgggcggtatggcagtcgggacactggcattgctctttgtcgttccggttttctacatcatctttgagtttttgcaggagaaaatccgtaaaccgatggaagaggaaccagatgtgcaggtgcttttagagaaagaaaagagtgaagttgaacgcgaacgtaaataaatgaaagaaagaatgaagaagaatatcatcacattagttgccatcagtctgtcgttgagcggttgtggcatctataccaaatatgaacccgccactgtcgttcccgacgatctgtacggcggggaagtggtgaccgaagacactgccggtctgggtaatatggactggcgggaactcttcaccgacccttatctgcaatccctcatcgaagtgggattgcagaccaataccgattatcagtccgcccagctccgtgtggaagaagcacaggccgtacttatgtccgccaaacttgcttttctgcccgcttttgctcttgctccgcagggaacagtgagcagtttcgatacgcagaaggctacgcaggcttattcgttgcccgttactgccagttgggagctggacgttttcgggcgtatgcgcaactccaagaaacaggcgaaagcactttatgctcaaagcgaagattaccgtcaggcagtccgtacacagttgatagcaggtatagccaatacctattataccctattgatgctggacgaacaactcgacatctcccgtcagacggaagaggcatggaaagaaaccgttgcgtctacccgtgcattgatgaatgcgggactggcaaacgaatcggctgtatcgcagatggaggctgcctattatcaggtgcagggttcggtcctcgatttgcagcagcagatcagtcaggtggagaatagtcttgccttattattggcggagacgccacgcaactatgagcgcggtatattggcaaagcaacagtttcctgctgacttctcgatagggattcctgtccggatgctttcttcccgtccggacgtccgctcggcagagcggacgctggaagcggcgttctatggcaccaatgcggcacgttcggctttctatccttccatcactttgagcgggagtgccggatggacaaactccgccggggcgatgattatcaatccgggcaagtttctcgcgtcggcggtaggttcgcttacgcagccgctctttaacagaggacaggtggtggcacaataccgcattgcccgtgcgcaacaggaagaagcggcgctcggttttcagcaaacgttgctcaatgccggtagtgaggtgaatgatgcgttgattgcctatcaaaccagtcagggaaaaagaatcttgctggataaacagatcacttccctgcaaacggctctgcgaagcactactctgttgatggagcatggtaatacaacctatctggaagtgcttacctcccggcagtcgttgcttagtgcgcaactgtcgcagacggccaatcattttactgaaatacaaagtttaattaacctataccgtgctttaggaggaggtcaggaataaactgtatcatactctctgttttctaatttaatgaaagaagggctgccggagaagtgattctgtggcagcccgtttgttggtcatatatgcccaacacattgaatctatatgtccaatacacacggtatatatagcttgcaagtagctgataaacagcgttattctaccagacttttcgctctttccaatgctacgttgatattcgggcagatattctcttttcccagcaactcgtagaatccggctttttccagtacattatgcacgttctcgttgactcccgaaagaataatggtagtcttttccttctgcgacatttcgcagagagcagtcaggttatgaatacctgtggagtcgataaacggaactttgcgcatacggatgatacgtactttcgggcggtctcccagttgtgtcattgtttcttcaaacttggtagcgatgccgaagaaataagggccgttgatttcgtatacctctatacctttgggaatcatcaggttttcttcgtgtacggtaatatccgattctttgttcgggtcaatctcatcggtaatcaccgagatttcggtagtctccatgacacgtttcataaagaggacgcaggcaatcaccaatcctacctcgatagcgacagtcaggtcgaagataacggtcaggaagaacgtgataagcagtacggtaacgtccgatttcggattcttcagtaaagctctgaatacacgccatccgctcatgttgtaagatacgatgaccagtactccggcaaggcatgccatcgggatatattgtgcgagtggcatcaggaagagcagaatcaacagtaatactactgcatgaatgattccggctatcggtgtcttacctccgttgttgatattcgtcatggtacgggcgatagctccggtggcaggaatacctccgaacagaggagctatgatattggcagctccctgtgcaatcagttctgtattggaatcgtggcggtcgcctatcacaccgtcggctaccgtggcagacagcagcgactcgatagctcccaatacggcaatggtgatagccaccggaaacagttccctgatagcttcccaatccaacgcaggcacaacggcatcgggcaactccgatttgatggtgaagcggtcgccgattgtctggatgcagtcgatccctccgaaagttttcatcaggtaaacggctaccgtgactacgatgatggcaatcagcgagccgggaattttctttgagaacttcggagtgatggcgataataataatgctgacaatactaacgatggtattccaccagttgatcgtgtcgaagtgtcggaaataaatcagccacttcccgacgaagtctcccggcactttctcgtctccgaaagataaaccgaaaatatcggcaatctgggtcgtgaaaatagtgacggcgataccgctggtaaatccgacgatgataggataaggaatgaatttgatgacagctcccagcttgaacactcctaataatacaaggagtacgcccgccattagcgtggctacaatcagtccggcctcgccgtattgttgtatgatgccatagataatgacgataaatgctcccgtaggaccgccgatctggactttgctgcctcccaacagggaaatgatgaatcccgcaatgatagcggtgataatacctttttcgggcgaaactcccgaagcgataccgaaagcgatagccagtggaagcgctacgatacctacgatgatgccggccatcaggtccgccataaacgtttctttcgaataattctttagacaagaaaccagtttgggtttaaattcaaatagcttcatttttagatgttattatacgtgtactctgtacttttttgcaaagtagaggttgcaaaattagataaaataatcgaaataagtatgtttttgaacatactatttgtctgttgatagatttcatcaatgaggtgatagtttttattcattaagaaaaggtggtttattgtgaacaaatcgtttatatttgcgttataaatagtacgacaagttacgtttggtaatcaaccaatttaaaatatatatagaattatggctaagagtattaaaggaactcaaacagagaaaaatctgttgacttcattcgcaggagaatcacaggctagaatgcgttacacttatttcgcaagtgcagctaaaaaagaaggctacgaacaaattgcggctattttcactgaaactgccgatcaggaaaaagaacatgcaaaacgtatgtttaagttcctcgaaggcggtatggtagaaatcactgccagctatccggccggtgtaattggtaatacacttgaaaatcttcgcgctgccgcagcgggtgaacatgaagaatggtcactggattatcctcactttgccgacgtggcagaacaggaaggtttcccgatgattgctgctatgtaccgcaatatctccatcgcagaaaaaggtcacgaagaaagatatcttgccttcgtaaataacatcgaaaatatgactgtattcgctaaagaaggcgaagtggtatggcaatgccgtaactgcggttacattgaaatcggtaaggaagctcctgaagtttgcccggcatgtctgcatccacaggcttatttcgaggtgaagaaggaaaactattaatctacggatgaattagatagaggggatatatccattaggtatatcctctttatatgttactatggaaatcatattatacgattcagaaataaaaagattaaaactctccaagtttcaaatggattatctatctttgctacaaattgcagttgtatgtcatcaagaagaactaataaacttgtagttccctttgtaaagtgggttggaggaaagaggcagatactttcagaaattgaaaagtatttgccttcaaaatttgcaacttactacgagccttttattggtggaggagcgttactttttcatatacagccaaaaaatgccattatcaatgattttaatgctgaattaataaacctttatactgtaataaaagaaaatccattagaactgatagcggatttgaaaaaacataaaaatgaagcagactatttttatgagattcggagtctggatagagatagagagaaattttcggcattaacaaacatagaaagagcttcgcgaattatatttctaaataaaacttgttataatggtttatttcgagtgaatagctctggggaatttaatactccttttggtagatataagaatcctaatatagtcaatgagataactataaaagctgtctccttatatttgaataattccaatgtcttaataatgaatggtgatttcgaggaggctttacataacgtttctaaaggtgatttcgtttatctcgatcctccttatgatccgttatcaaacagttcttcatttacgggatatactcagggaggatttgatcgtacagaacaagaacggttgagaaatgtttgtgattggctgcatgcaaagaaggcaaagtttctcttatcaaactcatgtactgatttgattcttgatttatataagaactataacataactgaaataaaggccattcgatccatcaattcagatgctgaaaagaggggacaggtctctgaagtattaataagaaattatgaataatgcaagtaagatagacactaattggacgaaaatttttaataaatatcctattctgcaaactataaaagatgaaggaaagtatattataacagcacaacaaattaaagaattttgggagcctcgtttgatgactaaacacgatcatagtgtcaatagaccccagatatttatagataattctttgtctattttgccaattacacgaggaagctatattattggtgcaatggacttgtatcatgattttgcattatctgatagagagaaagtctttgatagtacagatagtatgcctgtttcttcacctgcatttattgagtctattgattttaataatatcacaagtgaggctacggctattaatagcatatatgtttcggatattctcagggatttcttgaatgaaccgaccttgttgcctacggtaaatgggcgaatgggagctggaagtttctcatttagtgtcaattgtttgtcaggtgaagatacttctcttttagtggatgtaagtaactcacagatagagattgatggaggttatgaaggaacaaattctttgtgtttgattgaagctaaaagttctctttctacagattttttggtacgccaactttactatccttttagattatggactaataagataactaagcctatcagacctgtatttttattgtatagtaatggtacatattatttatttgaatatgcttttgaagaaataggtaattataattccttaaagagagtgcaatataaaaaatatcgtattgagaacgatgtgataaccttacaggatatacttgagataccaaagcgtattccagttgtcaaggaaccgcaaattcaattcccacaagcagattcgttggaacgcattatcaacctttgtgaaattatgaattcggataataaagcgtttaataaatatggtatagcaaaaatatatagttttgatgagcgccagtcagattattatgcgaatgcaggtgtttatttgggtttaattcagcggtataaaaaagggagtatctacaattataaactatcgaatttagggaaacaaatttttaaattgccattgcgaagccgacatcttcgggtggcagaattgattcttagccatagtccttttagacagacattgaagagttatattgataatgctaatatcccatctaaagaggaggtaatagatatcatgaggcattgcgaactttaccgcatgtctgaaaatttatattatcgccgttccagtacagtgattagttggataaattgggtacttaatttacgtactgaataaattcgtataatgcccttaaaatcatattataaatcatcggatggagcatttactcttttacttggcgattgtcgacaacttttgtcacagtttgattttcaatttgatatgatttttgctgatcctccttattttctttcgaatggagggatttctgtacaatctggtaaaattgtttgtgtagataaaggagattgggatcgtagttttggcaaagaatccattgataattttaattataaatggattgctgattgtcgtgacaaacttaaagataatggtacaatttggatatcagggacttatcataatattttttctgtagctaatcagttaactgaacttgggtttaaaattcttaactgcattacgtgggtgaaaactaaccctcctcctaatatctcgtgtcgttattttacatactcggcagaatacattatttgggctcgtaaaaataataatgtttctcattattataattatgattttatgaaaatgagtaatgctaatcatcagatgacagatgtttggaatttgtctgctattgagggatgggaaaagatacacggtaaacatcctactcaaaaaccgataaatttattagctagggttattgcagctagtactaggcctggggcatggatattagatccttttgccggtagtagtactactggtgtcacggctaatcttttgaaacgtcgatttcttggtattgatattgaacaaaagtaccttgaacttagtattctacggagaaaagacttggattttcctaaggttcgtgcagattttctttctaggatttacagcattaatgttcatgctatctctttagaagataaataaaattgaagtaaaatacttgaatttacaatattagaaaaataaataggatggatagttcttatatggaaaaggtacatttactgaatatccctgcttaaagatacaaaaaaggcaactgacttgcaatgagttagttgccttaaattttcttattttaggaatatccctacctatttttcggatagccttttttgtattatctattgattccggtaatctttgggagatacaccgtattgctttaaaaactcccgatagaaataagatttattagagaatccacatttaaacataatctcggatacggtcaacttggttgtccttaataacttggctgcatattccagtctgatgcctcgtacaaattcactcggagtcttatctattatttctttgaacttccgatataaggtagctttgctcactcctacaaattcggcaatagaagaagggcttaataactcatcatctatattattctttatgaagtctgttacattctgtattaactcttcgtcttccggatgaagaacaatcccgtctttcactttcacagaagacatgctggaattgaaatagtcctttaaaagcatttgtctcgacagcagattctctatggtggatatcacctgcctcgggtgaaatggtttgacgatataagcatccgcaccatggttaaaggcattaatctggtcttctacagaagcctttgccgatattcctatgatcggaatataacttgttttcaaatcggatttcaatttattaatcaagctcaagccgtccatattgggcatgacaatatcacttataataatatcaggatgattatgttctatctctttcaaagcctccacgccgtcttttgcttcgtgtatcacataatcaaagaggacatctttcagcaggtctctgatattcttttcatcttccactatcagtatgacagtatctttgcgaggggataagtgatcctgcccgttcttttctttctgcaacgaatctttttcatccgttacaacaagtgaatgatcggatggtagagaaggaatcacgactgaaaattcaacactttttcccagttcactatttacacttatctgcccgcctaataattcaaccagactcttggttagatttaaacctatgccattgcttacagagttacccaatttgggagtatcaaatatcttatacttatcaaatatctctgccatctgttgctcggttaaccccttgccggaatttcttacgagcaagtataaggttttatcaggctcattttgtgatatttcaacatgaatatatccataacgaggagtatatttgaacgcattcgacagtaaattgaatataattttttccaaagcattgcggtcggaatagatctctgacgtatcatgagtctctaccttgaagtctattttattctctttcaggatatccacataattgttggaagcatattccatcaatgattttacgttcacattttcaggatgcaaatccatattgctcgatttagttttacgaaactccatcaactcactaatcagcttctgcatcctttcggcattattctttattatttggagatatttctttgtactaccatctacaccgtcctgttccaacaagtgctgtgcaggtgtataaatcaaagttaggggggtaaagaattcatgtgccacattggtgaagaaattgagccgggattcataaatcttctgttcatgccgtttctctacctgggctataagaacctggcggcttaaccgtatgcgatttttgataacagactttgtgatgtagaagataataatgcacaatatggcatagataatcaatgcaggaacactaagccaccacggataacctacttttatagttaagcgataaatgttatttccccatactttgtcgccattcgtgctcttcacttcaagctggtactcacccggaggaagttgggtaaagataatattcgggttattacccatccccacccaatcatccgagtggtttttcaagcgataagcatattcacagttttcattattaataaagtctttggctatgaaattgaaagtcatgaatctttcttcatagctaagttttaacactccttttctgatacgttcattaatgtcctgtaccgtattatatatcttcaaactacttaatataagtggaggattaaacttgcgcaaatgtatatttcgaggattgaaataactaaacccgcttactcctccaaagtacaagaaatcacgatgatccttgaagaaagctccatccgagaattcatcattctgcaatccgtcattcaaggtataattatctattttattgttttttacattcaggctagacaatccctggttggtactgatccatatcttttcttcgtggtcttttaatattccatgaattgttttattattcaatttctcgtcggcatattgtatcaggcgaaaatcattctcctcctttttcaattcgttcagtccataacttgttcctatccatatattggcatcatcacgcagtaagcacaatacatcattattggtcagtaaaatccgactgtccatatcctccaatgattttatgctgttatctttcatgttgatacagttcaagcctccgccacgtgtgccaaaccataacatattgttttccggatcggatgtaatggcataaacaacatcgttattcaatgagatattcttatccgacgaattatattgcctgaatcctttaacgtgataacgaccttgctctctggaaatatttattttgattaaaccatatcctgatgttcccacccataaaagagaatcattgttcgtaaaataaatgttgtacacagccttgaaaggcgggtatttgtcaggtatctctagcttttccaatcgtcccgtagcagcattcaatatattgattccggttccttccgttccgataaaaatgtcattcgctttatttctcctcaaggcatagacagaattggaaatcaatcctttactctcattcagataatctgtcaattctttcgttgcaggattcaacagttttattccgcttccttttgttcctatcagaatattaccatcttcatcttcacaaaaacatctcacagggtgactggtgtgaacggtttcaaataaagagtcgtaatgataaagttgaattaatccttgtccgtccgttcctatccacaatatgttctgactaccggaataaagagtgaagactgataactgactggatagttcgttcaggtaggtaaaagtattcttttttaaatcataatgaatacatcccccttctataaagctgacgtacatcttgttctctgctaaaataacctgcgatacaggtttgctactatccagctcaatgcattgggaaactgtaaagtcgggatttaaaaggaaaagtttgttgtctttgtttaagataaatctgtctttcgacagaaatatcttatctacaggcgtctgtatgtcgactgtgcgtaaatcactctgttttcctccgttaacgagtagattgtaagtcagatgcacggtatttccattatttaaaaggaaaagcatacgatcggaatcactcacggaataatcctttatatgacttgcaaagtctgtgttaatcggattaaactcatcttcagaatcattgtagacaaagaaccccagcccctttatgaggcagataatatctcctgccgcactctttcctaaaataaaagacttttcctgattgggtactttattatctgttcttaaataataccttgttatctgacgggttcgtttatctaaccgattgattccattatctgttgctatccataaactgcccttacattcgataatctggcggataacgttattacttatagaattcggattgtttttgctatatctgaatgtcgtaatttctcttccattatatgcattcagtccatcccatgtcccaatccagattgtatgttctgcatcttccaaaatacagtttactgaattatttgtcagtccgttaacatttgatatgtgttttgccacattaaaagcataagactttgtggaagtgacaaatgcaataatcagaataaaaaataattgtgcgtataagatgtttctcatgtaaatgaatgttatttatacggttaggataatagcaaatataaggaatttattttattccgcgcatattttcatcggtaacggaggacttatacaattgtggaatagtcaaaattacaaacgataatctacgatttcaccgtcaacaatcaatttaccatgtttctttgtttttttagcggaagcaggaatacaaacaatagttacggcattgtccgggttcaggataatgcttgtttcgccggtacaatttttctttatgtattttttggataccagatcgtacaagtccgtaggttccgtaaagtgttgattcaaggttacctctttggcttcaaagtaaggattgaataaaaggtaagtaggatattttcttgtggaataaaaatctgtggcattacaatccagttgaagaatacattccacattagtagtatctacaatagaggctagcatacccacccaggccgagccatacaagcaaatatctgtagctgaagacatggtttttacttgatccccaatagcatagggaccctcatcggacaataatccctggaacggttcaaagtgattgccatgatacaaatccttcctcaatccttcataacaaatgacgtgttgaggatcaccttcccagatagaacttgactgacggttgcgggggtgctcgtctgcataaaataagcggcaggcgtttgccaggttcagcatccacttgcctattgtggaagcataagccgggttgtattttacaattgggacaagtgcggcagcttgtgaaaaggtgttcatggcaaaagcatattgttcatcctttttttgtcctaccaatccgtgtacgtcgtatttgttccaacgctcacacatcactccccatccgtcacggtctgaattattaccgtcgaagcaccagttcagcattttcagctcatcataagcagttccaagttctgcattcatgcgcactgccagataagccccatagggcatcattatctcatagaaagtaccttctttctggggacggttttgcaagaatgccatgcattggcgtgtagcattcagatactttttatctccgtatttaatccaggagatgtattgcaaccaagcaagtcctgcggctgcatccggttcacgccatactttattatagtaccctttacggttcttaaagttgaaggcggtgaagttgaagtccggatattctctaccttcactcaagtcttgaatagcagcataccaattgtcgacagtgatcttcatcggctcctgcatctctgttttttgaggatataaatctaccagcatcgaataagccattgccggccatatctcataccagaaactttctccggctttcctgtcgagtccgttcaatataagattggttccattcttcttgttgaagaattgccgtatcattgatacataatcttttccgtcatcattgcttttgtctactcctatcagacttgcactaatgagtgagcccatagtgggaagagattcataagaatttcctcctaaccgtcttttatctacgtagcttggaagtccgaaagtgcggaatggaaagtttacttgcgaatcgtcccaccagataagaggtaagttctgtcctttggcgttgaaatcgtaaaatagtctgtcctgtttcgtggctatatctttccagtttttcattttataggggaaaggtacattgggcatatactgtactaagcggatctctttttgttctatcggcttttgtgccggcaggttgttgagaaagaaaaaacctgctacgagaaataataatgtctttttcatggtcagttggttgttaaaaaagggcggattataaaatccgccccctcattttattcatattaaaaacccggattttgggaaagaatattgttgctcttatccctttcaccttgcggtatcggaaacagataatctctgtcgtccctaaaattggcacctttcgatgtattatatttggttgcataagcacgcataacggttccgaaacgtttttgtctcatcaggtcatcccgtctccatccttccattgccaattcacaacgacgttccttccagatgatttctttcaggcgctcttggtcggtttctgttatgtcgggcagtgtattagttgttgtagcaggaatatacgcctgttgatctcttctcggatctatcggattagttttgcgggctctttctcttacatcattcaggtaaggaagtgcaagccctggttttccattttcgtttaatacttcggcatacatcaagagaacatcggaataacggattaaacgaatgttgtaactaatcatccagacgtcgaaacctgttttttctactgctggcacagtcatcttgtaatcatgataaccgcttggagattcagcattgtcctgcgcttcagtatcacctttatatctatcaccagtttgtgtgaatacataagtaatacgtgggtcatctgcgtcaaaggcatcatggagatcttgggttggtacgtgaaatccatatccttgataaccggagatgcgtctgcttgtgaagaagtgagggacattggtacctgtggctatgtttttgtcatatactttgttggcaatctcaaatactgattccgaactgttttcatattcagtgcgccagttcatgccgtaatcactcaacaatgtatagtctttgtccacttcaataatatcatgaagtaccgtttcggcagaggtaaaatcacctttgaacatgtatgttttagcaagcattgttttagcaaagccacgtgttgcacgataagcatcaccttcagagtaatctccttttgcaggaagtgcggaggcatcggttaaatcattcacaatacattcatataccttctccaatggggagcggggtatttgcagtatttcagcgggttgcatcggcgtagtgattagaggcacttctccgaatgtagtgaccagacaatagtacccgaatgctctcaatgctttagcctcgtttgcataacgtttcaatagttcttcgtttcctattgcatcaggagcataataaatcacatcgttacagcgattgattaatctgtacagaatctcccaacgacgtcctacttcaccattggttgtgtagatcgtaaagtcggacaagtcgcgtacttcggcacggtcaccgtcatttcctcctccttttagagcatcatcggtgctgcaatcacccacaaaataatgatttaatgcatattcattccaagttgtacgtaattgaagataagctccagtcaaggcttgttcaatatcgctttccttctgataataattatcgcttgtggttttaccataacttggttcgtcgagagagcagctatacaaccccactccggcaagagcccagcatattataaataatatttttctcataatgtaatgtctttttagctagatttaaaattgcaaattaactccaaaagtgaatgtacgtgaagacggataacgtgtagtatccactcccatatccaatgggttattgatacccagttccggatcaagtccggaataaccggttaaagtaaatatattctgaccgctcacatagaatctacaacttgaaaacagtttgctcttctggcaaatgtgactcggcagtgtataacctatttgcatattctgcaaacgcaggtaagaaccgttctccacatagaaagaagaacctctcatattattgttagagtcagagttggttatgcgtggatatacagcatccaaatccccgtcttttgtccatgcttttgtgtaagcatccgccaacgcattctggcgtcctgctgaagcaaggcttcctttagcaacgttccagatgtcatttccaatagttccctggaatgccatacttacatcaaagttcttataactgaatcctaagttgaaaccataaatgaggtccggattaggatcaccgataaaagtacggtcatcatcatcattcaattcgcctgattctcctaatttggcaaacttaaaatcacccggttgtgcattaggctgaatcttggtaccattcttatccacataattgtctatctcttcctgattctggaatattcctatttgtttgtacccccagaaacgtccgataggacctcctacatacgtacggctagtatttccactcaaatattccgatgtaagtttggttacctctgtcttataagtagacatgttcagccctacattgtaattaaagtcttttcctatctggttacggtagttgactactatttcgaaaccggtattcttcaagtctcctgcattgaagaaggggctgttagggaaggcgccaaaagaaggaataggcatattcagcaacatgtcacttgttttctttacataaaagtccatacttacatcaaggctgtttttaaagaaagacatatctaaaccgacattggtttgctggctggtttcccatttaatatctgcatttcccacataagtcgggacgtaaccttgtgagtatccgtttccaaagtaccattgattttcattattggtaccaatcaacgtaagaggtgcgtctctgtcgattcgttggttaccattctgtccccaacctacacgcagttttaaattggaaattgtattttcaatgttcaggttcttaaagaattcttcattgctcactctccaacctaatgaaactgatgggaaatagccccaacggttacgtttggcaaatcttgaagaaccatcggcacggaaattgactgtagcaaggtatctgtcatcatatacatagttgatacgtcccaggtacgacaacatagaagatgtttctttacctcccgaggtgttatctccggctgtttgtgcatcaagtatctgatagatttcatcgttacctaaagcctttctcttaaatgcattaatgccttcgctgctgttcttctcataagtcatggcaaccattgcatccaatttatgcctgcctattgtcgtgttgtaattaaggcgttgttccacctgataattagaagtaacagcgctattattattcaattgagtttctttattatatttactttcctgattcgctaagttatcttccgaaaaagtagacgaatagacaggacggaagtctttgaaagtatcatggtatctttcgaaactatactgtacccgatagctcaatcctttatacaatttgatttgggcaaacacattaccaaatacattgaatatgtcattgtatctattaggaagttcgagcatggctaccggattagggtcgtaagaccactcggtaggcgcatatttgttatattcgtaattttcagaagacggatctaccaacgggctgataacaggggtaaaaggatcagctttttgaatgaaatcgaatgaaggaattgctcctgcgtcacgttttcttatctttgccagattgacattggcgccaacagtgataaatttgttgatatcatattcaagattcgccttaagtgaaagtctcttgaattcagtagtgataatcgcaccctgatcgtctacatatcctaaacttaaagaagatctcgaattatctgtccccttacggatgcttagattatagttctggttgaaagctgtacgggttacttcattccaccagttggtattatagcctttctgatactgattggtaaacttatccttcattgagttttgaaagcttgcatcgttttcatacgctttcatgatgaagttgtagtattggtcgctgttcatcatgttcaatgctttataactgttttttacacctacataagcatctaatgttacagtcgtttcacctttcacccctcccttggtagtaatgaggattactccattagaacctctcgaaccatagatagcgcaggctgaagcatcttttaatacttccatacgttcaatatcagatggattcaggctgctgatgttatccatgaactgtccatcaactacatacaatggattgttgtcattgacggtccctaaacctctcacgcggatcactgcatccgatcccggctggccggaactggcggcaacaaatacgccggctgccttacctgttagtagttcggatgcattggacactgcatagttcttaatatccttactacttatagaagccaaagcaccggtaaggtcactctttctttgagtaccgtaaccaataactacaacctcatccaatttattatcagacactagatttacattgtacgttccgctatttgttacgtttacaatttcagttttaaaaccgacatacgagaatgaaactttatttgacgatacttttaatgtatatttaccgtcaaaatcagtgatagtaccattggtcgttcccacttcaagaacagaaactccaattaaagcctctccggtattactgtcgtataccacacccgaaatactcttggtttgctgtgcaaagacatttgtgcaaacagcaagaataagaatgaataataaatgcttactcatagtttatacacttagatttaattatatgaaatgatattttgtttattcgcaataatcttaccatctttcagttctaattctgttccggcgggaagttccacaattactcttgcgtcgttggccgggatctcaacggagccatttgtctttatattttttgctatatattctttggcaacaatatcaaacaaatcgcatggttgggtagcttgataagtaatggttttggtctctttatgagggttataatagagatagaccggataaggtttctctgtatagaagtctgtgacattacaatccagccgaagaataccttccacgttcgtttgacaaacaatggcccccaaaataccaacaggagaagaactgtaaacgctgaacatgctctccgtcggattaccttttatccatttgggaccatcgccgattgcaaccggactaaccccttttaatgatgcttttccatagtcatccgtttttcgtaaaccttcataagaaacattatcataagtaatgtccttcaattcaggagcccattgatgtgtttcatctatttcccccggatagaacaaacgacatgcacttgcattgttcaacatccacttgccgatagcttttgcatattgaggctgatatttcaccatcggaatgaaaggccaggcaggtttgatactgttcatgaggaatgcatatcctccgccgtctgtgatacttccttgcagaccgcttacatcatagtcaccccattttcctacaataattccccaaccggttcttcccgtagggcttttacatccgtcaaatacccaatcaagaagtttggctacatcatagttggctccttctactgcattcaaataggctgccgtataaactccgagtggtaaaagggcctcgtaaaaacggctttctttttgggcaagcagggcttcgatggcacttttactatgttgcagataacgtggatcgccaaacttatgataagcacacaacaatacataagcatgcccaccggcggcgtcttgttgcaatggaatattattaaccattcctttcatttgtgcatagtcaaaataagaatagtcgtaatttccattcaatacagaatctgctttaacaaactgctccgcaatacttttttgtatcttctctgccccgtctacattggggaaaacatcgcaaatagcataatataaggcattgggtaatacatcataccaccagtcgcggccatagcctcctcctaaaagggctactgacggagtcgtattgttcatgactatattccagccgttatcagagttgaaataattctgcaccatttttacatagttatatccgtcttgattcgtcttgtcaatccctacaaggccggcaccaagaatagctgccaatgagttcagactttcatggaactctccgttattggcattttttccctgacgaatatctttaatggcagtatataagccaaatgtagtctggtccatatttctgcgggcgtcatctaaccagattaatggtccgacttcgcttttattattccagtcaaagataaactggtcatacttttgggctttttgcttccagtccagcattttataagtttcaggcatatcaggcatagagtctaccctatggatggaaacctgttttaccttttcaccaaagttattttcgttgcccgagcaagatgccaggagacaaacggtcataagtacaaaaacacctttacttgtcattttcatgttcaatagtatcagtttgattagtaatattcttagctaaaggatatgccgctaattgtaatccggcaacaatcaccagcgcatatttcaatgcaaaatcctgcgatacacaataagcaaggaagataaacagtagtaaaccgaaagctcttccaaggaaaaggccgaactcatggcttaggatatatgcatattcgtttctattctcaatttttgcaactgcatcaattgttctcatcataatggggaagtaagccaggtcgaacaaaggctggaatatcactttgcaaaggacgaaaaggatcactcccgtagcagagaagagaataccgttgaatagtgtaccggcaaagaatacgattagtcctcctacaaatattttcaaacggtcttgcgggcgggccatacgtcctaatacatacaccaggacagcggtcagtgctccgctaactccctgaatcaatcctaacgctccttcttctcctaccagcttcaataccaatatagccggtgccgttactaaaaaaccttgaaccattcctttcaatgcggctagccacagcatctttttccaaagtatgttgaagcggaaatagaggaagttcgtttctttagggttctcgaatttacctttccacagtgtcatgcaggcgataacggtaatgactactgctgccatcgtaactacacagtaagaggtattgatattgaagaggaatccgaaaacttcttttccatctatctggctgataaatgcgcctataattaaaggaacaccgatggaggtaatagaaaagaagaaagactctagtccgaagaaatagttacggctgttgtcgttggtattatagagagccagcaggtatcggttggtccaaaagaaaccagaagctgctcccattaaaaagccggccagaccaagttcgatgaagccaagtgacttgatggtcatcataccgaacatggaaatgccacttaccaggattcctaccgaataaagtgtcttcacactgtatttctttagcagatagccgttaacaagagaggtagtaatgatgcctatatacattgccagctgataaaaagcaaccatcaccggatcgctcgtgttcctcatgatataggctcccacaaagatttctactatcggtagtaccaatgcataaagcatattggtaaccaacagtgttctcatgttaggttcctgttgcttaaagaacagatattcttttttcagtttattcattacttcttttgtgtctgttttaatacgtttaatatctctgaaatggaaagctctgccttacaaatcacttcatcgcttgctccataatacatggttatcgtatcgccgtccaccaaatgcccattagtgaaaactacatttccgaagaaacctgtttgctcataagcggcgataggttccatgataggttcttcgcttcttgcaatgactttcgacgggtcatttaaatcgagtaataaagcccccaagcaataacggtgattaaaatcggctccatgataaatctccagccagccttcttctgtctttattggagctgcccctgcccctacacgtgcgcaatcccacattccgtcacgagtggttgccacacatttgtgatttccccaatgcaagcggtcgggcgattctgccaaccatatataattgccaccaagttcgggactgctcgggcgatgaagagcgaaatacttgtcacctatcttctgttcgaataatgcacaatctttattatgcggtgggaatatcattccatgccgtgtatagtttttccaatcattggtgtgaatcagtccgacccctacagctaccgacgatacttctgtgaaagtaaggtaaaaaccatcttcggttgttgcaacacggcaatcctcaataccgaatgcttccagctctccttttccgaaaataggtggaaattccggttcatctttgaagtgaataccgtcggtacttgaaaccaatcgtaagtaagacatcgtagtcagataattctttcctttgtaaccgataacgcgtgggtctgaagcatccaaatcgggatcattctttaaaaacgaaaccacttctatttttcctttttcattatatataggaaaactgataattccttctttctgtataggtctctctgcgacgcgcaaaagtaaccaaattttgccttgatatttgaaaactccgggatttaacaaacatgtaatttccattccgttgattcccgcttttaaatcttttggagccagtagggggttctgctcacatcttttagctatatccataatatttcgattagtgattatttctgtgaacaaaagtatgagatgagagacaggaaagcgtttactatattctcaaagaggtgtacacatgctcaagaacatgttttaagaggatgatattggggaatgattttagaagaggcagagatattcgtatttatatgttgttactatttaaacatttgatttatagataaatatgcggtgtattgaagtgtattatattctcataagtgtatagtatagtttctttgaggagtacaagagaaacatataaagataaaaaaataagaggccaaactcaaaaatataatttgaggaagcctcttgttttttctttttaataagaataatactgtaaatcctatttcttcacgtgcggataatctatcgtataatgtaatccgcggctttccttacgctccattgcttggcgcataatcagataacccacattcaccatattacgcaattcgcagatttctctggatgctacgctacgtttgaacaggctttcagtctcttcgtagataatatcgagtctgtcccaggcacgtttcagacggaggtcgctgcggacaatacctacatacgtactcataatctggttcacttccttcatgctttgcgtaatgagcaccatttcctccggagagcgggttccttcatcgttccattcgggaatatcttcgttataagaatattgatcgacagtttgcagactgtgtttggcggcagcatcggcatatacgactgcttctatcaaagaatttgaagccaggcggttgcctccatgcaatcctgtgcaggaacattctcccacggcataaagacgttcgatggaagattgtccgtccaggtcaacgaggatacctccacaaagatagtgggcggccggggctaccgggatataatctttcgtgatgtcgatgccgaggctaagacatttttcgtagatattggggaaatgcttctttgtttcttcgggatctttgtgggtgacatccagatatacatggtcgtctccacggttcttcatttcgttgtcgatggcgcgtgccacgatgtcacggggagcgagcgaaagacgggggtcgtatttctgcatgaactccttgccatccattgtacgcagtacgcctccgtagccgcgcatcgcttccgttatcaggaaggaaggacgatctcccggatgatacagggcggtagggtgaaactgtacgaactccatatccttcaccgtacctttggcacgataaaccattgcgataccgtctccggtagcaactagcgggttggtggttgttttataaacagctcctactccaccggtagccatcagcgtcactttagcaagataggtatctacttttcccgttttcggatcgaggatataagcaccataacatttgatatccggtgtctggcgggtaacggttacccccagatgatgctgtgtcaggatttcaatggcaaactggttttcgattaccgtgatattcggatgccgttgtacggctttaatcaggctgtcctgaatttctgctcctgtattatctttgtggtgaagaatacggaattccgagtgtccgccttcgcggtgtaagtcaaattcgcctttctcgttcttgtcaaaatccactccccacttaatcagttcttcaatttgtgcgggagcttcgcgcactactttttctactgcggcacggttactgatccagtcgccggcaatcattgtgtcttcaatgtgcttgtcgaaattatccaccagaaggttggtgacggaggctacacctccctgggcgaagtacgtattggcttcttccagcccgcttttacagataagagcaactttacctttgtgcgccactttcagcgcaaaactcataccggcaattccggaaccgataacgaggaaatcgaattttcttaccataatcttgttatttctcaccgcaaagctacaaaataagttacttcgttgtacttttcgttgtcactaattcataaaattgctaccttgcaggcaaaaatctgacaaaatgaatcgaatttttcatgcccgcatcgcctggtaccaatatttcctgttggtggtgcttactgtaaatgctgttggcgcattgtggtgcaaatatatcttggtagcggtactgtttatgctgatgctgattgtagtgatcgaacagattatacatactacttatacgttgactacagacggtaacctggaggtttcacgcggccgttttattcgtaagaaggttattccgctttccgaaatcaccacagtcaggaaataccattccatgaagttcggccgtttctcggtgacggattatatcctgatagaatacggaaaaggaaagtttgtttcggtgatgcctgtcaaggaacaggaatttgcagaactactcgaaaagagaatgtttgaaaagaagataaaagagtaactgattatatactatgaaatatcaagtgattatcatcggtggcggtcctgcgggatatacggctgccgaagctgccggtaaaggcggtttgagcgtattgcttatcgaaaagaatagtctgggtggcgtctgtctgaacgaaggctgtattcctacgaaaacattgttgtattcggcaaagacttatgacagtgcaaaacatgcatcgaagtatgcagtcaatatcccggaagtctctttcgatttgcctaagataatagctcgtaaaagtaaggtagtgcgtaaactggtgctgggagtgaaagcgaagctgactgccaacaatgttacaatcgtatcgggagaagcgcagatcattgataaaaatacggttcgctgcggggaggaaatttacgaaggggagaacctgatactttgtacaggctcggaaactttcattccccctattccgggagtggacgcggtgaactactggacgcacagggatgctttggacagtaaagaattgccggcttctttggctattgttggtggcggggtaatcggtatggagtttgcgtcgttcttcaatagtttgggagtacaggtgacggtggttgagatgatggacgaaatcctgggtggaatggataaggagctttccgctttgctccgtgcagaatatacaaaacgaggtattaaattcctgcttagtacgagagtggtcggcttgtcgcaaacggaagaaggggctgttgtttcttatgagaacgcggagggaaacggcagtgtcattgcagagaagctgttgatgagtgtcggccgtcgcccggtgacgaaaggtttcgggctcgaaaacctgaatttggagcagacggagcgtggtgctatcagagttaatgaaaagatgcagacttctgtgccggacgtgtatgtttgtggtgacctgacaggattctctttgctcgcccatacggctgttcgtgaagcggaagttgccgtacattccatcttgggaaaggaagatgccatgagttatcgggctattccgggcgtagtctataccaatccggagattgctggagtgggtgaaacggaggagtcggcctcaacgaaaggaatcaattatcaggttatcaaacttccgatggcttactccggccgttttgtggcggagaatgaaggcgtgaacggagtctgcaaagtattgctggatgaacagcagcgggtgattggcgctcatgtgttgggaaatccggcttcggagattatcactcttgcgggcactgccattgagctcggattgacggcagcgcaatggaaaaagattgttttcccgcatcctacggtaggagaaatcttccgggaagctctataaacggattccgatatctgacatcgttcattgatgaagatacctatctgattcattgatgagggggtatctcactgataaatcgaatatatgatgagaaaatatataatcactccggccttattggcaatagtttgtatggtgatgtgtcattgtacatttaatcgtaaagcgtcagttgccgccaatgaatatttgattcagggcgaattggccaatcttcccgacagcattgtgatcggcctgtatgaggaagacggaagtattctcaactgtgtatggagagatacgcttatgaatggacagttctctttccgcgacacggtttctaccacacggaaaatgctgattatgtctgataatcggggcttcccgggtacatggctggaagtgtggatcgcaccgggagaatacatcgaaatcaaggggcaggacaaactggtgaaaacatgggaagtagtaagcgatgtgccggaacagcaggaagaaaaccgctttacggcttgcgcgatggcccaacagaaagaactgatgcaatacatggcagcagaatatgactggcaacggatgatgttcatagaccatccgggcgaccgggagtttgaaagccaggcctgggccaaaatagattctatccggaaactgtcaatgccgttgcagcaggaaatctggaaaaaggaaatggaatacatggaagaagcgcccgtctctccggtgtggatggacagattattgttatttgcttccatgatgaaatatgaaaccatcatgccttataaagaagaggtaaaaaaactctatgcccgaatgtccgaagccgataaacaaacagatgacggacaggagattacaacctatgtttatcctcccactacagtagggattggagatatgatggtggatggagacttgtatgatgcgaatgattctctccgtcatatttccgaattcaaaggaaaattcatcttactcgatttctggagtagcgggtgtggtccttgcgtggagtcgatacccgaaatggagaaggtgatggatctgtataaggataaaatgactgtaattagtattagtgaggacccgaaagcacgttggaaagagtatatcaagacgaaaggaatgggcggtaaccagtggaacgaacttcgtaaaggacgcaccggtcttgccctaaactatcaggtacggggtatccctcattatgtattgattgcccctgatggaaaaattcaggatgtatggtccggctatggctccggttcgcttcttggacaggtagagaaaaacttgaaatagatatagaggtaagatactatcatttgttgatgtcataaactgtattgtatgaaaaaaagtcttttgttggtcgccctttcagtttgtttgttgccactttggggacaacaaaatttctcccggatagattcgcttatcaagaagatgctccccgaagcatccgaggtcggcatatccgtctacgatctgacggctaagaaatcgctttataactatcgtgcggagaaactttcccgtcctgcctctaccatgaagctgctgacggctattaccgcactctcccgccccgaagccaacgagcctttccgcacggaagtatggcacgatggcgtgatagagcatgataccttgcaaggcaacctgtatgtagtgggcggattcgatcctgaatttaacagccagtcgatggattcattgatagaagaggtaatcactttccctttttcggttattaacgggcaggtctatggtgacgtttcaatgaaagactccctttattggggcagcggatgggcgtgggacgatacacctgcgggttatcagccttatctctctccgctgatgttctgcaaggggactgtacaggtttccgtagttccatccacggtgcagggcgatacggcaagtgtttcctgccagcctctgtcttcttattatacagtgacgaatcagacgaaaacacgtacctcttctgccgggaaattctctttcacaagagactggctgacgaatggaaacaacctccttatttcgggtaatgtcacttcgattcgaaaagatgatgtcaacatctatgattctccccgtttctttatgcacactttcctggaacgccttcgtgggaaaggaatcacgactccccagtcgtatggctttgccgaattacctcgcgacagtgtgagagtagagcgtatggcttgctggaacacttctgtgcagaaagtgctgaaccaactgatgaaagagagtgataacctcaatgcggaagcatttctctgtcgcctgggagcgcaggctacgggaaagaagcaagtagctgccgaagatggtattgtcgaaataatgaagctgatccgccgcttggggcatgacccgaaagattataagattgccgacggttgcggactgtccaattataattacctctctcctgccctgctggtggactttctaaaatatgcgtactcgcaaacagaagtgtttcagatgttgtataaatcacttcccgttggtggggtggacggaactttgaaattccggatgaaaggtactcctgcttttcggaatgttcatgccaaaacaggctcgtttacggcaataaatgcgcttgcaggctatctgaagatgaagaacggacatgaagtggcatttgccattatgaaccagaatgtactttcggcggctaaagcgagagcatttcaggataaggtgtgtgaggtgattattgggaaataggctgatatgaatacattagcccgtacaaccaaagtggaattccgttgttgaatccgatttctatgttgtcaagaggcaggtactattttccatggagggctctttattgattcttctacaaaaggacaattgtattctctaataagcaaaaatcgtaggattttgtttaccagagaatacaattatacttgttttgaatcgaatactgtaaattctatactctatattatatttactttgagtattcagcccaattagtattcttcatatcgccactcttagccaactctgcgtgcataccaagtgcagcctgaatagcgtgtggagtctgtgcccggttaccggccagtttgaggtaatcccaaagaagctgtttgtagtcaggatgtgcacagttttcgatgatggcttgtgcgcgttctttcgggctcttgccacgaagatcggcaacaccttgctcggtgataacgatgttgacatcgtgctccgtgtggtcgtggtgggataccatcggtacgatcgcgctgatcttcccttctttggccacagacggacaagtgaagatagagatgtaagcgttgcgggtaaagtctcccgaaccaccgataccgttcatcatttttgttccgccgatatgggtagagtttacgttgccgtacaggtcaacttcgatggctgtattgatagaaatgataccgaggcggcgtactatttccgggctgtttgagatttccgacggacggagaaccagtttgtcgcggaagaaatccatatcgttgtagatgccttccagacagtcatttgtaacagtcagtgaacaggcgctaccgaatttgatgcgtccttcgcgaatcaatccgatcacggaattctggattacctctgtgtacatttcgaatgcaggaatcgttttatcacgtcccaatgcaccgagtacggcgttggcgatgtttcctacacccgattgcaaaggcaagaaactggacgggataataccgcgtttcatgtcggctgcaaggaagtcggcaacattctggccgattttgtcggtcaacggatcagcggcagcgaaagaacgcgcttcgtccggccagttggtttccactacgcctataatttttttcgggtctacctgaacgtaaggcagtccgatacggtcactcggtttatagatcggtatttcgcggcggtaaggcgggtcgagcggttcgtatacgtcgtgcatacccataccggatttgctgtgtgcgctgttcaactccacgatgatctggtcggcaagacggcagatggtcggggcgatgccgccggcggcagtcagataaatttttccgtccggagttacttcgcaggcttcgatgatggctacgttcactttgcccatgaacccgtagcgcacttcctgtgccatttgtgagaggtgtatgtcgttgtaggcaatctctccgttgttcacagctttgcggaagtcggcgttggtagtataaggagcgcggtagcggatggctttggcacgtgacagtacgccgtcacaggattcccctgtcgatgcgcctgtgaaaattcctacttgaaacgggtttcctttcgcatgttctgcttcagcaatttttgcgagttcggctgttacagccttggccgttccggcgggagtaaatccgcttaggccgatgttgtagccatgtttgattaggcttgcagcttccgctgccgaaatacgattgagtgacataaatagtaaatttcgtgttaaatacagttgatatttttattgataattaattctctgtttgtacggccttgtaccaatgcttggcaatgactcgtcacataatgattcgaaactcaatgagtttacgggctctctcaatacttccgttgaagtatctctccccagataatagcgcggcgggcttcttctgcggagtgaatcgtgaaatcatgttcgttatcagttgattcggtgtgagagttataatgagaaccttgttgggaatttcgtttatcttgcgcggcactgtttgccagggatgcggaaacggatatttcttctttttttcttttctgctgcgccgctggtttcgccgtctgtttgggagactgttgcggtggcgtctgtttcaggggtttaggctggaataattcttccagcgacttggggccaccccatgcctcgggcataggaactgcatccggagctacttcaacgggggatggcatcggggaaacggggcgtttattcttagcttttttcgatttactattcttattcacctctttgaatattcccacaagaatgacacctgctatcaagagaaatttcaaaaaatcttccattgtgtttcactgctaattagttatctgccaaagttacgtattttatctggttcaggctaacattttattatgaaaaaagggcagcttcacagctccccttaatttttttaacctaaaccttaactatgaaaaaatctaatgtttctttcattgcacaaatgtgaaaaataaatttaaatttgccaagcatatcgcctaaaaatgtttattctcttaacataaattacaaatttgcttgccaaatcataagtttttgcgttattttgatatcaattcactacttattgaaagcgaagccgtatctttgcatccgaatttttaaactaagatttgagtatgaacgaattaacgggagcggactttaaatccgcaactgaaatgaaggatgacaacaaaaagttgtttatcgaaacctatggctgccagatgaacgtagccgacagtgaggtgattgcctcggtgatgcaaatggcgggttattccgtagccgaaacgctggaggaagccgatgccgtgtttatgaatacctgttccatccgcgacaatgcggagcagaagattctgaatcgcctggagtttttccactcgctgaagaaaaagaaaaagcatctgattgtaggtgtattgggctgtatggccgaacgggtaaaggatgatctgataacgaatcatcatgtagacctcgttgtggggccggatgcttacctgacgttgcccgacctgattgcggccgtagaaaccggtgaaaaagcaatcaatgtggaactatctactaccgagacttatcgggatgtgattccgtcgcgtatctgcggcaatcatatttcgggttttgtatccatcatgcgtggctgcaataacttctgcacctattgtatcgtgccctatactcgtggacgcgagcgcagccgtgacgtagaaagcatcctgaatgaagtggcagacctcgtggcgaaaggctataaggaagtcaccctgttggggcagaacgtcaactcttaccgttttgaaagaccgacaggcgaagtggttactttcccgatgttgctccgaacagtggccgaggctgctccgggagtgcgtattcgtttcacgacttcccatccgaaggatatgagtgatgaaacgctggaagtaattgcgcaagttccgaatgtgtgtaaacatatccatctgcctgtgcagagcggcagttcgcgtattctgaaactgatgaaccgtaagtatacccgtgagtggtatctggaccgggtggcagccatcaaacgtatcatccccgattgcggactgactaccgatattttctccggttttcattctgaaacggaagaggatcatgccttgtcactttcgctgatggaagaatgtggatatgatgccgcttttatgtttaaatactccgaacgtccgggaacgtatgcatcgaagcatcttgaggataatgtgcccgaagaagtgaaagtccgccggctgaatgagattattgctttgcagaaccgtctgtctgccgaatccaaccagcgttgcatcggtaaaacgtatgaggtgcttgtggaaggtgtttccaagcgttcgcgcgaccagctgttcggtcgtacggagcagaaccgtgtggtggtgttcgacagaggtacgcaccgtgtcggtgatttcgtcaacgtgcgtgtcacggaggccagctcggctacgctgaaaggggaagaggttgctgcggattagtttgttgcagaattttaggaccgaacaagtgttgcgtggattagcatagactattccatttaatatacttctcactgtagaggatgcgaagggcacagagttagagaaaagctctgtgtccttcgtgttttctgcactctccatattcttcatatcttgcgtgctctctctatggtgagacttacatcatcatgtgccttctgatggagaacttcacaatcgccatcgcattgatggacgcgaatggaatatccatcggctcatgatgagtattatagctcacgagcttgagatacccttctttttccgaacgattcacgtacttcaccgccagatactcgtctccgtcaatcataaacgacaccaggtatatttccccgtaaatgacattatcgaaactgctgatttctttatatccgataatgtctcccgatttcaatatagggtacatgctgtctccgttgacgtagaccgccccgtcgcagacggatatattgggaatccatattttccccagtgcatattgctgcttgttggtgaataatgttttcaggttcgccgccgccgtaatatcgtataatgtcacgctacggtcgtctataggttctggtgttttcggattgtgtataatctccacttctccttttaccagttcgctttcgcaaaatctcggctggtgtttcggattcccttttcctaataatagccagttgtagtccaccttgtctccgaatttgtcgagtaacaggcggaaatcaatgctgtttcgtgcaccccagttggatactgtggcacgtgagactcctaaatattcagctaattcgctgtcgttcttgaagtttagcacctgtttggcacgcttcacaattcctgtgacatctaaaaatgtatccattttatgatcgtttatttttgatgtaaaaattcataaactcgttaattgctcattgataatctgttatctactttttgaaagttaatttccaaaatcttttgttttctttatgaaatctgttttatatttgtagcaacgaaatcacaaatatatttcaaaaatataaattttaaatagaaaaaccatgagaaacaacaaaaagtttacgaaatgttgcaaaatacctcattcaccgcctttttaaggaaaccgtgccggacgggcagaagtaatagtaagcctgcttgcagcgtctatatatcttgcatataagatctatatatcctgcgtgtagcatctatatacccaatgtgcagccgatatatctccaatatacagcaactatatgtcctgcgcgccagcgatatatcttcaatatacaaacaaatatttaaatatgaaaactataaaaacggaaaagcaatatggaaaccattatgaacaaatctctatgcatctgcggatgttgcaagcgggagcttccacaggaagccttttatatgaaccaacgtacccgtactacggacaactactgcaaagaatgtcgtaaggcaaacgcacgcagacatcgcaatcaggataaaagtatattatttgaaaacaaatctgtttcctatccggtgataaccgaggtgaaggactacgctttgcggatgttccttatccgtcatgcccggcaagtggtgtcggacagtatccgccggaagcaggaaaaggaaaaactacgcgcactatgggaagaataaaacaggggttggattatttccccatgagcaccagtttcatgcacgaccgtatagtgcgtcgtgtcatgaaacgggaaggtgatgccgcttttgccacattggtagaaacgctgtcgtacatctatgccggaaaaggatattatatccctgccagtgatgagttttacgacgaactgacggacagcctttacaatacggatcttgatgatgtgaaacgtatcatcgccctggccgtggagtgtggactgtttgattccgggcttttccggcaatacggcatcctgacttccgccgatatccaacggcagtatctctttatcaccaagcggcgcagcagctcgttgatagcccccgcctactgcctgttggaagcggaagagcttgcatcgtaccacacttctccaaacagcaaaaacagtgcggaggatgctgataacaaaacaggctgtgatgtaacaccaactgctgatactgtaacatcaaccaccgattctgcaacatcggaagccgaaatgtcgacattgggtacacaaaacaaagaaaaacaaattaaaacaaaccaaaacaaattaaaccacctctctgactctcctcaaggagagaacggaggaggaaaaattttgaaaagaaggaaggtgatgacacaggaagagatcgacaatctgcaaccaccgtccgacggcacgcagcgtaacttcgagggactgctggagaaccttcgctcttataagattccgccttccgagcaatacgccattattctgaaaagcaacttcggagctatcggaaacccggtgtggaagggattcagcaacatccgtgggagtaatgggaagatcaaattgccgggacattatcttttgagcgtaattaattaatttatgaacgcactttgaaaaaatgattgggtcagtctgaataatacccgtatctttacagtgtcattaagcttaaggacaaaactaaactaatttattaacacgtaaaaactattacaattatgccagtattgtacaaacccttccagtcagttctggaggacaagaacaaaaagaaattatttcatccccgtgtgatttacacggccaatgtgtcaaccgcccaactcgccaaagagatagccgcttactcgtctctatccacgggtgacgtgaagaacacgcttgataacctggtgacagtgtctgcacagcatctgcaggcatcggaaagtgtaacgctcgacggcttcggaactttccgtatggtgatgaagtccaacggtaaaggtgtggaggtgccggaaaaagtatctgccgcccaagcttcccttaccgtccgcttcctgcccaactacaccaagaatcccgaccgtaccaccgctacccgttctttggtgacgggtgccaagtgtgtccgtttcgaccttgccgatacttcggcttccggtggcggagatagtggtaaacctgatggtggtggctccggcagcggtggttccggcgacggcggtggagaagcaccggatccggcagcatagtctgcacgtaggtcgcaacacaaacacaaatggctgactaaacgactaaacggagctttttaactagactagtaaactaaactaattatccactaacatgcgaattattaacttaatcgtggtgcactgtagtgccacgcggggggattgtacgctctctccggaagatttggaccggttgcaccggcgccgcggattcaacggaacaggctatcactactacatccgcaaggatggaacggtgcacctcacccgccccatcgaacgcatcggagcacatgcgaaaggtttcaacgctcactcgataggtatctgctatgaaggtggtctggactgccggggacgcccggcagatacccggactccggcacagcgagccacacttcggcaactcgttgggcaactgcaagagaaattctctggctgccgggtatgcggacatcgggatctttcgccggatcttaatggaaacggtgagatagagccggaagagtggattaaacagtgcccgtgttttgaggtggcaaaggaattcaaggaacttgaggagtttgctatcaaaacagaaaacacggaagaacacagagtaacacaacacattaaaaaacagaaaggaggtaaattatggcaatgaagaaatcagtatgggatatgatcctgaaggtggttatcgcagtggcttcggctttggctggcgtattgggcgctaatgcgatgaatttgtaatttttcaatagttctatcattttataattctgcagattccggagtctggaatctgcagaatttcaaaccaatatttcaacacagattaagactcaaactaaatgctatttcctccgttttttaaccatttatataacaaaaacaaaatatgaaacgattaatttttatactatcatttttcgctgcactctttccttttacggcacatgcagcttctacagctccatacgttcccctttctgtccccacttctccgcaggcggcagccttcaaaatgtatggagatgtggccgtgaatcctgccatgggggtgcccgacatatctattcccttgttcgacatcgatcatcacggctatcggttgcctttgagcttgaaatacaatccggctccgttccatcccggctacaactatgacgtgttcggccgtggctgggcattatctatcagcagttgcatatcgcgaagcatagaatgcatgcccgatgaacttacagactttaaactggataccgacaagtttggagagtcatataggaacttatcggaagaatacctgaacacgttggaactaaagtccgacctatttaccgctatccttcctgatggtagttccttcgaattcgttatcagaaaaacctatgacggcaaaatcgaatatgtagtttcaggtggacgtgatgtgaagataacccatgctactagggatagaaagattatatcttttaaagtggtggacgaacagggtgttgagtatgctttcaccggtgccgataccacctttagaggaacggggtgtacgattactccctacaacaccacttatgtgtcctggcaactaacctctatccgtctgccccattcttcggaacttattacttttgattatggcaagagtattcattctaactttgggtatcagcaggcagaaccggcagtacgtttccatcatttttatgagttagggtgtagtccggatgtatttgacgtcactgtacatacttatacacggcagcatgcatatcagatgaagcttctgacttccgtcacttatggtaccaccaccatccgcatcaattataaggatggtacaaacagtgaatattataattatgcccaaagtatcagtataaaagacggagacagacttgtgcggaccatcaacctggaacagcatcagggcactttgcaatctagcagtttatcaaagtcgcctttcagcatgcttgactgcgtcactctgcttggtggtaatgatgcatcatccgagacttatcggtgtggatatacatcttcgtatgccaactttggtggaacagaccattggggtaacctgaattttcgcagcaacaattatgacgtggcctatatgaatctgttcgtgggctttgatgtgtccagagccagtagctcttttgtaacagacgtaccaaaagacgaaaatgatttgtctcctttggataaagtgagactctctaatgtgccctacaacacacgtaaacctgccggccctgaaagccattgtgtactccgcaaattgacctatccgacaggaggctacacagagtttgactttgagaaccacaagttcttctcattcacagatgatgatggagactatattcacgataaaaaaaagcgcgtgaagaccgaggctacaggtttcaggattcgtgaaatcgtcaactatacggcagaaggtgtacgaagcgattccaaacactactgttacgggaaaaccgaatacgaagaaaacggctgggaaatcggacgctactaccatacaggcgcaggcgaaccaaccctcgatcctaccattcagacttatatgaactatcaatcgaccgaccttccaatgtcggtactgaacatggttctgggacttgatccgaatggacaatatcgatccttcaaatccaatcccttcatgagttatagtccgtcaggaggatatcctgtttacacctgggagtgggaatgtacgttcagtgcattcaacttccagcggcttctgaacggccgtcccgcagtggtctatcccgaagttacagtctattatttaaaggatggtgcaacccaatttagtcctgaaaattgcaatggaaagactgtctatcaatatgacatctatgaagcaatgcagaatgacaccgcctttttcgagaaaccgcagtactatggcaatgtgctctggtatgaaggagagaaatatcgttataatctattaaaagaacagactgactacatgagcaacgggcgtgaatataaactgaagcggcgcgaatcactgatttggcgttacggtggctcgtcggtgatagattgggaatattccaattcatacggaaccccatcattcgtccctgcaaccgctgttcttggtaatttctatacttctacctgtcagatgcttggacactcacttctatacgaacgtaaagtaaccacttatgacgaatcggaaactggtattacagatacagaacactacacctatctctccggcaaccggatgcgatggaaagaacggaatgcaggaggcctacatcgggagactaattgggaatatccggctatcgcgcgaactggtacaaccccggatattgttcgcaaaatggtggaaaaacacatatttaaccccgtgttgaaagagatacagaatcaaaactcttataattatgaaggcaatagacgtgaattcggagagtttcctacagaaagtggggatacgctgatattgcctgcccgattttatcagacaatttacgatccgagttcacactacagcgaagtcctcgtttactcttccaacggaaatccccgcgaagtagtttctaaggataagttacatacggtctatctatggggatatggtgatcgctatcttattgccgaaatcaagaatgccactctagagcaggtggaaaccgccgtgtcctccgtctttggcatgacatcctccgcattggcaaagagcactactcctgataccgccaagctaaaggcattgcgcaaccatacgtctctctcggaagcacatgttaccacttttactcatcttccgttggtgggtgttacctcaatctccgatccttcagggaagacttcgtattacgactacgatggactggggcgcctgaaggcgaattactattacgaaggtaacgtcgtggatgaaagcaagaaacgcgtcgtgcaggaatatgattatcattaccgtaactaataaacaaaatatgtacaaacttatgaaacgaatatatttacttctttcgctcttattgtgctctcttttatgcatgtcgcaggtgagcacttcacagaactatattagcacacgtacttacacctcgcccgaccatagcggttgccgtgaacaggtagtatactttgacggtctgggccgtccctcacaaacggtagattgcggcattacgcccgacaggaaagatcttgtctcattacaagagtatgatgatcagggacgcaagttacgcacctggcttcctgccaagtcggcgggaaatggcaattacatgaccctctcttccttacaaagtggtgcaagctcattggcaggcggtgatgtacgtccgtacctacagaccacgtatgaagcctctcccttgaacaggccggttgcgcagcatggggcgggtgaggcatgggcagagcatcctgtaagttaccaatatatcacacgtaatccccgatcctttccctcgtcttattatatgactccctccggcaatttcttgggagtctgtactaccgatgaagacgggaatcaggcttatgagtttaaagatggattcggacgtacaattctggcgggacgcatggacggtcctgatccttgtttcgcttattatgaatatgacaaccacgatgatttggtgaatgtttatccgccctttgtaacttactaccaaatgaatgagcccgaaggaccttatcaaacacagagtagttactcctatcactatgacttccttcaccgctgtgtttacaaaaaacttccggagcgtgacgccatctattacatttacgatcatggcgaccaccaggtgctttcgcaggatggcgagcaacgtgttcgtggagaatgggctttctctcttagcgatgaattgaatcgtccggtactcacgggcatttgccacaattcttattattacgctgacttccctttgtgtgaaatcgatgtgaaagcgcgacgggatgatacaggcactgcctttcatggctatattctcgaaaatatcccgctgacgaatcctgtagtgtatacagtgaactactacgatgattattctttcatcggcaagcacggagtacccacgtctctgaactatgtcacacctccctcgggttatggtacctgctatacggaaagtagcaaaggattgttgacaggaacagttacagcccgtctggatgctaccggtgtgaccggatatgattatgccgctttctactatgacgaacgcggacgcatcatccaaagccgggcgacgaatcacatgggaggcatagaggaagaatacgtagcttacagctttacgggagaccccctgaagcggcaacatgttcataccgccacaggatatagcacacaaacggaagtatgtacgtacgagtatgaccacgcaggacgtcttttaacgacaaagcataagctgaatacgaatgaggaagtgactctcgttgaaaacacctatgatgacttgggacgaatcaagagcagtaaacgccatggcaactctgctcttacaacagactatacctataatgtccgctcatggatgaagacactgactaccgatacgttgttcaaccagaccttgcattacaacgactcatacggcggaagcagagcttgctacaatggtaacatatctgccatgagctggaaagccgcaggcgacacaggagtgcatggataccgcttcagctacgacgaaatgtcacggttgactgctgcggggtatttgtggaacggatctcccagtgcaaactatgacacctcctacacgtataacaggcagagcaacctcacttcactccgtcgtaacggacgcacaggcacttcatcctacggtttgattgacgacctgacgctcacccttgatggcaactggctgacacgtgtggatgatgccgccacatcgtcggcttacaacaacgggttcgaattcaaggatgccgtgaagcaggacaatgaatacacctatgacaagaatggcaacatgaccaaagatttaaacaagaaaattactgatattcaatataattgtttaaattcgccaagtaaagtcacgttccaggatgacagtaccattacttatacgtatgcagtgaatggcacgaagctgcgcacggtgcatacgataggcgatactaccagtacaacggattattgtggcaatgtgatctatgaaaatggtgcacagaagttgttgctcactgatgccggacatattacgttgtccgataagaagtatcactactacttgcaggatcatcagggaaacaatcgcgtagttgtagatcagacggggcaaaaggaagaggtaaaccattactatccgttcggaggcacgtttgcttcagcggagaagagtattcagccttataagtataatggtaaggaacttgatacaaagaatggattgaattggtacgattatggggcgaggtattatgatgtagcgattggaaggtggaatgcggtggatccgatggcggagatgtattatagttggtcaccgtatgcatattgtgtagatagtcccacaaattatgttgatccgacagggtgtttttcaactaaatttggagcatggttatataaactgtttaatggcggggatcaaattttaaaggatataggtggagagtattttgtaagtactcaggtagaacattctggtgatgaggttggggccacagtaaatcgaagatttgattggaatggcagaaataccggtagaaatctagcagttgaaaaacaatggaatgcatatattgcagatactaaatttcaagagctttgcacaactcatggaatggaatatgtgagaacggaaaatcaatcagatgctgttgcagggatgctacagcctgcaatgcaaacaattataccagttccgtttattaaatcaggaaatgcattaataaatgcagtacgtggacaaaaaaatgtaacgactcctgttattcgatttggaggtaatgcaaatcaagtatatcacacttttcggcatacggacgctttaggcttggacagatcattagtgcagtcaatgatacgaactcattttgaaactgtttcttcacaagtggttgcgggtagaccttttaatcaggttattagaataagtggccgaaatatacagtatacagtttttaaactttctgatggtacatttaatataggaagaatacatgaagttttatagaataccgactaagcaagaggagcaacttattgaactacttgttcataagtcctctttaaaaatgtctgaagattggaaaaatggattattagtatgtccaatggatgatggggaaatgggtggtttatatttgtttccacagggaaaaataattgaaagtagaaaatttggtaaacaaattagcgaatttcaatttaaggatattgatggagttgaggttatcgcatccttaaatgtggatgttgatggaatcctatttgagctcgaaatatggaaaacaaattttgaaaaacttgtaaaattgcctgatttataaattgattactaccttgacatgttatagaaatatttttaggtgtcagggtagttttttatattattgttcgataaaacagatagtgtcttaccctgatacgaattgaccaaatatgttcaacttgtgtcagggcattactgatgttttatatatacgacgctcgcaaccatcaaatagacaaagatttgaataaaagataattgctattcaatataattgtttaaattcgccaagtaaagtcacattcaaggatggtagtactcttatacgtatgcagtgaacggcacgaagctgtgcacagtgcacaaggcaggaaacactaccaccacaacggactattgcggaaatgtgatctatgaaaatggtgtacaggagttgttgctcactgatgccggacatgttacgctgtccgataagaagtatcactactacttgcaggatcatcaggagaacaatcgcgtagttgtcgaccagacgggacaaaaggaagaggtaggccattactatcatataatgataaggagagataaaacggctcttatcggaacttcgggtagagaagatagtgtgtttgctgataaacagagtgaattgaatgtaaaaggagataaagtgatagatatgcattcacatccatataatgcccaagcttctgaccaagatatgaaaaatttgaaaataaagacaggtactgtctatcacagggatagtaaagtattatttttctacaatagtgaaaattcacgtattgggaataatgaatataaaatagatacgagtaaaacgttgttagataagttgaatgataaatttatgaagtaatgagaactacgtttctaaatttgatattattatttgttatagtaggctgtaaacagcctactataaacaaagttcagcaagcggtggaagcgcaagccaaattgcttgtggatagtggcttgattgctaatgaatatgtagtattatatgagttggctattaatgattccaaccatatatacagtattcaagcagctgattgtccggcagatttaaaatttgaatatccttcaaagatcattaagtacaaggataagtatctctgttttatagaattggatgaggcaccgatgtctgcaaaggaaatgatagaggcgtctagttattcgggcaatcttgtggtagaaggagacgggggaaagagttggcttttggttgtttccaaacttggagagaagaaaatattaatagatacttcattgcttaggggatggggcacatattttaatattaccgaattgtggccatatttttcgggatatgtgaaaggatgcccagtacagatgggggttatgtctcatgatgttgagttgagcgattcctatttaagttgtaatgtggatagtataaaacggaatttgctttggaatgagaaccagaatactacaatgataaagaacgtatatggacaaatgtatctgaaaaacaatacagattccgttgtttacctgtcatcaagtactaaaaaacattatgctgttgtagatggtcaggatagcctttatttgtcacttagtgattctttgcccattattttgggaccgaatgaaaaaaaaattttagaatataaaagtctgcctcgtcaagatgagttctttagaaatcttacgttgaaagaagatccctgggaatatttctataatctattttgcagatcaacatacagctttataaatgtaaatggaaaaaaatctcaaacaaaagtgatgtttcatgatattgataattatggatttaatgtttctatgacgtctcctagtattcaatttcagatattaaaccatggtatatatgataagaagtatggggaaatgtcgagattcagattttggtctgataaatggggtgctatgaataatgctgataagcagaggttatcagatgatgcagatgagagatttcaaagaaacgtgaatcaggtaaatctcttaccctgatacgaattgaccaaatatgttcaacttgtgtcggggtattactggtgttttatatatacgacgtttgttaccctgatatggaattagaaattattccatatcagggtaactttttatttgcttttacataaatgcggaaatgaaaggttgctttctcaatataatagattaaatttgcctaaccacatgtctgcgcatgcagaatatgcatttgatatttcagctagcctaattgtagatactgatgtcttaattggtttatctattaaaagtccttaacgaaaccccaatccatcactttttatttgtttctttgcaccaaattcgggtatagtgttgtcttgtcattcgaggcagcacttaattttgcttagatagttaatggagaaactcagtataaatgcttgtccggtgtgtggcggtacgcacttgaaacgcgtcatgacttgtacggatttttatgcttcgggcgaacagtttgaactgtattcgtgtgaggactgtggatttacattcacacaaggagttcccgtggaagcagagataggcaagtattatgagactcccgactatatttctcacactgatacgcgcaagggggcgatgaataatatctaccattacgtacgttcttatatgctgggccgcaaagcgcgcttggtagctaaagaggcgcatcgtaaaacggggcgtttgctcgatataggtacgggaaccggttacttttccgatacaatggttcgccggggatggaaggtagaggcagtggagaaaagcccgcaggcacgtgagtttgcaaaaacgcatttcgaactggatgtaaagcctgaatcggctctgaaagagtttgctcctgctagttttgatgttatcactctctggcatgtgatggagcatctcgaatctttgaatgagacttgggaaacgcttcgcgaattgctgacagaaaaaggagtattgattgtggcagtacccaactgctcttcttatgatgccaagcgctacggtgaatattgggcggcttatgacgttccccgtcatctctggcatttcactccgggcactatacagcagctggcttcccgtcatggctttattatggctgcacgtcatccgatgccgttcgatgcgttttacgtatctatgttgagcgagaaacatcgtggcagttcatgcagtttcctgaaaggggtgtttgccgggacgttggcctggttcaatgctttgggaaggaaagaacgcagcagttcaatgatttatgtattccgaaaaaaaagataacgcatgggaaatcaaaacaaatataagtcaggttcgattttcgacatgcagttcatcacgtcgagtatcagtacaacattagtgttgctgttgctgggactggttgtcttcttcgtattgacagcacacaatctttccgtatatgtccgcgagaatatcagtttctccgtccttatcagtgacgacatgaaagaagcggatatactgaaacttcagaagaagctgaatcaggaacctttcgtgaaacaatccgaatatatctctaaaaaacaagcactgaaagaacagacggaagcaatgggaaccgatccggaagaatttttgggctataacccttttaccgcttccattgaaatcaaactccattccgactatgcaaactccgacagcattgcgaagatagagaaaatgattaaaaagaacaccaacatacaagatgtgctctatcgaaaggagttaattgacgccgtgaatgataacatacgaaatatcagtctggtactgcttgccttggcggtagtgcttacttttatctcttttgccctgataaacaataccataagactggctatttactccaaacgcttcctcattcacaccatgaagttggtaggagcgagttggggattcatccgggggccattccttcgaaagaatgtatggagcgggatattggcagccatcgttgccgattccatattgatggggaccgcttattgtgccgtgacgtacgaacaggaattgcttcaggtcatcacgcctgaagtcatgttgatagtctgtgcaagcgtattggcgtttggaattgtaataacgtggctatgcgcctatttctccatgaataaatacttgagaatgaaagcaaacagcctgtactatatttagcggatggcgaatggctgacggcaaacctgtgtttgcgtgtgattagcatccgtaacaaccgactgatagattaagggaatgattgaaattagtaatttgtaattaaataaactatgtctgacaagcagaaatttgcctttgataaagtgaactttatcttgctcgcgatagggatggcgattgttattatcggctttctattgatgacgggacctacatcgtccgaaacctcttttgaacccgatattttcagtgtacgcagaatcaaggtagccccagtcgtttgcctgtttggcttcttgtctatgatttacgctgtattacgcaaacctaaaacacaaaaaacagaagaataaagatgggggatttaacaacatttgagacgattattattgctattgtagaagggttgacagagtttctaccggtttcttctacaggacacatgattattacacaaaacatattaggagtagaaagtacagaatttgtaaaagcatttactgtaattattcagtttggcgcaattctttcagttgtctgcctttactggaaacgctttttccggttgaaccatacaccggctcctgcaggcgcttccgctttgaagtgttttctgcataaattcgatttttactggaaactgctggttgcttttattcctgctgcaattttgggtttcctgtttagcgataagatagacgagatgctggaaagtgtagcgatagtggcagtgatgctggtaatcggtggtatattcatgctgttttgcgataagattttttcgaagggaagtgaagataccgtgctgactgaaaaaaaggcattcaatatcggtttgtttcagtgtattgctatgataccgggagtatcccgttcgatggctaccattgtcggaggtatggcccagaagctgactcgtaaggatgctgccgaattttcattctttcttgccgtgccaactatgtttgcggcaaccggttacaaggtgttgaaactcttcctggatggtggcaccgagattcttgtcaacaacatgccggcacttattatcggtaatgtggtggcttttgtcgttgctttgctggctatcaagttctttattagctttgttacgaaatatggctttaaggcgtttggctggtatagaattattgttggcggaaccattctggtaatgctgctgcttggatacaacttagaaattggctgatgaattttaaaaagggagaagtactgtttttcaataaacctttcggatggacttcatttaaagtagtagggcacgcccgctatcatatttgccgtcggatcggagtgaaaaaactaaaagtcgggcatgccggaacactggaccctcttgcaacaggggtgatgattgtatgtacaggcaaggcaaccaaacgaatagaagagtttcaatatcatacgaaggagtacgtagcaacgttgcgcttgggcgctactaccccgtcatacgatttggaacatgaaatagatgccacctaccctaccgagcatatcacaagggaactggtggaagaagtgttgacgcactttatcggtgccatcgagcaggtgcctcctgctttctctgcctgtatggtagatggtaaacgtgcctatgaactggcccggaaaggcgaagaagtcgaactaaaagcaaaacagcttgttatcgacgagattgaattgctggaatgtcgcctggatgatccggaaccgatgattcaaatccgtgtcgtatgcagcaaagggacttatatccgcgccttggcccgcgacatcggcgaagcactccatagcggagctcacctgacaggattgatccgtacccgtgtaggtgatgtccggttggaagactgtctgaatcccgaacactttaaagagtggatcgacggacaggagatagaaaatgaggaagaaaataattaacgtaataaggaatagatatgaaattatcacaattcaaatttaagttacccgaggataagatcgctctacatcctatgaaatatagggatgagtctcgtttgatggtattgcatcgtaatacaggtaagattgagcacaagatgttcaaagatgtgttggactactttgatgataaagatgtgtttatattcaacgatacgaaggtattccctgcccgtttgtatggtaacaaggaaaagacaggtgctcgtatcgaagtattcttgttgcgtgagttgaatgaagagcttcgtttgtgggacgtattggtcgatccggcacgtaagatacgtatcggtaacaagctgtatttcgggccggacgattcaatggtggctgaagtgattgataacaccacttctcgcggacgtacgctccgttttctttatgacggacctcatgacgagttcaaaaaggcactgtattctctgggtgaaactccactcccccactctattatcaaccgtcccgtagaaccggaagatgctgaacgcttccagtctatttttgcaaagaacgagggtgcggtgactgctccgactgctagtttgcacttcagccgtgagttgatgaaacgtctggaaatcaaaggtgtggactttgcatatatcactttgcacgctggtctgggtaacttccgcgacatcgacgtagaggacttgacgaagcataagatggattcggaacaaatgtttgtaaacgaaatggcggtgaaaaccgtgaatcgtgccaaagataacggtagaaatgtatgtgcggtaggtacgacagtgatgcgtgctattgaaagcgcagtcagcactgacggacatctcaaggaatttgaaggatggactaacaagtttatcttccctccgtatgaatttaccgtagccaattcaatgatttccaatttccacatgccgctttctaccttactgatgattgtggctgcttttggtggttatgaccaggtgatggatgcttatcatgtagcattgaaagaaggttaccgtttcggcacgtatggagatgcaatgctgattttggacaaataatggcaaaagtttatctgggactcggcactaaccttggggataaagaacaaaatcttcgggatgccgtgcagaaaatagaagagcaggtagggaaaatcgtttccctgtctgctttttacataactgccccttggggattttcttccgataacagtttcctgaatgcagcggtttgtgtagataccgaattggctcccatagacgttttacagagaacgcaggcgattgaacaggaattgggacgtacgaagaaatccgtcaacggcatatatagcgaccgcctgattgatattgatctgttgctttatggtgatttgatactttccaccacttctccttcaggagcaaagttgatcctcccccatccgttgatggcagaacgtgacttcgtcatgaaaccactggcggaaattgctcccggattagtgcatccggtacttggaaaaacgataaaggagcttacttcttctttttctccgcaataaagaccggtaaataggcaatgcatcctatcaatactgcatacagcaaatgaatctcctgaaacggcttgtcgatgaaatggcaaacaatggcgtagatagcaatcgtgaagcctatataaagagccagcaccaaaagcgtttttaatttcttatttagaatcattataaatctatttatgtgttaaatacagggcaaagatactcattatctccgaaatctctttatctttgcaaccgaaatgaaagtgtggacagatttgagtagcttgcaaccacggaaaaaaatgctaaaacacgtctgattgacgcctttcggtttatcctttgcagcactcgcctctcctactctctctcattttttaattttcaatttttaattcttaatttaaaaagatgggatacttatttacatccgaatcggtgtcagaaggacaccccgacaaggtagccgatcaaatatcggatgctgtgcttgacaaactgttggcttacgaccccagttcgaaagtagcttgcgaaacactagtgactaccggacaagtggtgctagcgggtgaagtgaaaacaaaagcgtacgttgacctccagctcatcgcgcgcgaagtgattaagaaaatcggttataccaaaggagagtacatgttcgaaagtaactcttgtggcgtactttccgctattcatgagcaaagtcccgatatcaaccgtggtgtagagcgtcaggacccgatggaacagggtgcaggcgaccagggtatgatgtttggctacgctaccaatgaaacggaaaactatatgccgctttctcttgatctggcacaccgcattctgcaagtgctggccgacattcgtcgtgaaggaaaggtgatgacttacctccgccccgatgccaaaagccaggttactatcgaatatgatgacaacggaactcctgttcgcatcgatacaatcgttgtttctacgcaacatgatgactttatccaaccggaagatgattctcaagccgcccagctgaaagctgacgaagaaatgctgtctatcatccgccgtgatgtgattgaaattctgatgcctcgtgtcattgcttctatccatcacgataaagtgttggcactgtttaatgataaaatcatttatcatgtgaatcctacgggcaagttcgtaattggtggtcctcacggagataccggtttgacaggtcgtaagattatcgttgatacttatggtggtaaaggtgctcacggtggtggtgctttctccggaaaagatcctagcaaggtagaccgtagtgcagcttatgcagcacgccatatcgcaaagaatatggttgcggcaggtgtagcagatgaaatgcttgtacaggtgagctatgctatcggtgtggctcgtccgatcaatatttttgtagatacttatggccgttcccacgtcaacatgacggatggtgagattgcccgcgttatcgatcagttgttcgatcttcgcccgaaagcaatcgaagaacgtctgaaacttcgtaatcctatttatcaggaaacagccgcttatggtcacatgggacgtgaaccgcaagtgataacgaagaagttttcttctcgttacgaaggagataaaacagtggaagtggaactctttacatgggagaaactcgactacgtagataaaattaaagctgcttttagtctgtaaaacagtctgaaagcgaggagcttagctcattcgataagagccacaatctcaactccttctagtaggatatgaggttgtggctcttgattttaaataagttatatttaaataaatatcttttggatattaaacttcttttgccagaatttgctacttttgacctgtaaataaacggactgcctaatgaaaacaagatgttgttatcctaaacgctatttattgttgttctttagtttacttgtcagcgtaggtagcattctgatgtctgtctctctatcttcctgctcttcttcggtgaagagtccattgctactatctgctgactcattgatggaaatatatcctgatagtgcattatccattttggaatcaatttcctccccacagaaattaccatgtgctgacagagcactttatgcgctattgcttacgcaagcaaggcataaaaattatattgctttaggagatgactcgctgataaaaacggctgttgaatactatggtgataagaagaaaagtgtacgtgctgcaaaagctcattattattggggagctacttatggtgagaaggggtatacttcatttgctgtagacgagtatctgacggcaattcggttgatgcctgttagggatgaattcttagcaatgatttatgataatcttgcggactgttatgaaaaagatgaattagataatgtagcaatggaagcttatcgcgctgcttatcagatattaaaaggaaaaagtggacaaatatatccaatgcgaggtattgcgcgtatgtttttgttgcaaaataggaaggatagcgcattgttttattatcagcaagcgcttgattgtgcattggcggataaagactctagcttgataggggctctttatcatgattttgctatggtttataatgaaaaaaaagattatattctggcaaatcaatatgtatcgaaggcaattatgatacaaggggagggtgctgttaatgcttgtttgtcaaaagcccaaattatgttgaacttgaatcagcttgattctgccagctatttttataataagaatatgagccaacttgatatttatggaaaagccgtttgttatgatggaatgtatcaaatagcaaagaaaaaaggggagtggaaagttgcaacagagaatatggatatatacaaagttctttatgattcaattcagataatgaccgataatgaggaacttaatcggcttatggataaacatcaattagaagagcataaaaggttattgtcagaacatgctaaaacgttggtttttactttagttgctgtatttttctttttgatgattatatgtgtcttttgttttatgtggaatgatagaaaaagaaagaagtattatatagctttgcaacatgaattaactcaaaagagagtcgatactatgctgttgaaagacgaagaggtttcagaatctaataaagagcatatagataagaaaaggtcagagttgacagaacaacaaatccaattgtgtgtatcggtactgaaaactaccgattgctacgatcaattagagacattggaaaaggcaactcctaaacagttgttggcgatgcgtagtttaaggaaggatatacgttctactatttctaatgcatttgttgatgtgatggtaaatttgaaagagcgctacccaacattgactggtgatgatgtcttttattgtgtcctttcattgctttattgttcaaaaactgtcatgatggagttgatggatgcaacttcagatgctcttaaaacacgtaaaaatcgcataaagataaagtcgatgctcaacttttcgaacgtgtatttggagctgataatcagtgatatgtaatgcttaatctctgcttatcttttttttaaatagggtcttgttaccattgttaccacgtaaaaatcgtttcttttgctgcatctgtgtatttttggagctaaattttaaacccatttattatgaaagctaaatttttacctcttttattgttggctattttacttcaagtaagtatgttctcttttgcgaatgaaatgacatctgcgcgtcgaatcagactaaaaaataaaactgaggtacaacatcggtctatccctgttactcctgatgcttgtattgaaaactcattgttgtctattgaccttctttctactgttcctactgtaactgtaattataaagaatgcagaaacagatgaagttgtttatacatctactgatttaaatgtagataaggtttatattgatcttacaggtgaggagaaaggtaaatatactttggagatacaacttccaaaggaggcttttactggagattttgaattagaataaatctttgaaatatatattatttgcaactaacataatgatgatatacctaaatcattaactgatgaagccccgctgttgaaatatatggcgcattgctgaaatgacgatttagatgaccgaaaggggaaagaatcggttaacttttattcgtgggcttaataagccttgtgaaaggctcattaaggtatattgaaacgtaaaattaaaatcactttttttaattgtgtgctgaaatactactggtagggtgttcgaacgattttatagttcggataataaagttcattcagcaacaatgtgatacacctgttagtagatgagaaatctgtgatagatgtattctctgtgagaaaagctcttggacttcttattttagaagtccaagattttttttagagagagtatgatggaagaaatggctgacgaagaaaaagtgtcttttgaactattcaaatatattatttggattatttgtgaggtaatttctgtgtgttacctcttgttacttattttgtgtgatactgttacttctgttaccaagtaaaattcgttcctttccttatacctgcatacctttggcataaatctttaacacacaggcattatggaaacgaaacttctattctttttattgtcaggtattttattccaatcaaatataggtatatatatgatggagcaaaccgagaaatgtcaggttactttgaagattgctattcaaatgcactcgcattctatttctatttttcctaataacttctggaggagttcgtagatgttgcttagttggcatttacattaactgttattatgactattccaaaaatgtagaatgggatgaataattaatttatcctgttagatggatattgtcattatgtatttgggtaaaaatacttttctgagttttctctcttaaataaaaacaaatctaaatttaaccaagatgaaagaaaaattattgattttgggagcaatggtggctttgtgctgctcttgtgcggggaattctgtattattagatacggaatccgaattgaacggcttgaacaatgagtatgagctaggtacgttggaagtgagtgataatggtctaaaatgcgaaactttgggtgatgaagattctattcaggttttgaaggacaattatatcgcggaaattatgggacgtatggaagttgctaaagagaaggtaatgcgtacggcttatggtgcaacatcgcctagggtcggagttttcagggttggttcttgtggtaattacaagtatttatcaataaaaattgattgtgaaaacggaaatagtaaaactagcgtaagtggtaatgttggagatacgtatgttgatggtggagataatatgcgtctcgaattttgtatggtggatgcgggatttcgttatccggggggagtctttttgtttgaggatgtacctttagagaccatgacattggtccgttatcatgatacggaagatggtggtcataatggcgtgtggtctgatgatcctaattattatgatgtaatgcatatttctggaatgtctaaattagattctaatgctacattggcatggaatataaataggaatatgactaaatggggcgatattccagtgggacctgcaggtattaattatggggtcattgctcctgctgaaatggcttcaggtaatttgtattttgatgatgaagatcataataataagaattgggcacaagtttggttaggaccccaaaaccaatatgaaccgcatggtacatattatggagtccagctggatcgaaatacaagatatcacgtatgccttaatacggataaaaccaatttcacaaaattggtgcgatcagctatctaattattaatttgtttataatcaattcttattggtaaaacttaccaataagaattgatttaattagcacatagacatgaaaatattgtatttctttctcttctcttttctttttattgcttgcaatactcctgttataaataagaatgatgttgttgcagaagtgaatggagaacagattcttctttcagaattggcgtctcaaagtaaacaagagatttttgatatattgaatacagcgtatgaaatcaaaagtcgggtacttgcaggtctgatcaaacagaaactgttagaagatgcagccaaaaaagaaaacatgtctttggaagagtttatcgattggtttgttcagcagaaaatatgtgtagggcaggatagtttgaaaaaacgatatggatttaatacacaaagcttttatgtaaaaggtgaattaatcccgttagtgaaaggttctttggaggagaaactatcttatcaacagaaacttcggagtcggattgttcaggcattggttgattctttatatcaaaaggcggatattaaaagatttttatatcctccaaaacagccggaatgtgttgtgagggatttgtgtgtatattatagggggaatttagactctcctgtttcttttattgttgcctctgattataattgtgagcgctgtgtacaatttgaaaagacattgtccaagctctatgataattataaagagcgggttaaatttggttttgtgcattttgcagatgctccttcgttagcagctttggcatgtgaggctgctggtgagcaaaaacaattctggacttttcatgatactatatttaactattcaggagtagcagattccgcttttatatataacttagcaaagtctaaaagattgaatatgacagaatttgatgcctacttacattcttctgacaaatataaggagatggataaggtcatcaatcagttagtagaaagggggctgatggctactcctaccatcataattaatgatcgtttggtgtacgtcacaaacagctatgaagaattgtccagactattggagtatgaactataacacaaaagataaaagatgagactttactttaatctgaataagataacttatctgtttctaatgcaggctttatatctttgtattgcttgtgaggagccgtttgatgtaggtatgccgatcccggaagatgccatagtatttgatggagtgataaccgatgaacccccaccctattattttgtattaagtaaaccgtcaactaaactgaaataccctgaaaatcgtagttttgataggattaatgatgcagaaattgttattgttgatttgacaacaggtataagagatacattacagaatgccaaattgactggttatcaggattttcgattttatgatcactatagagataaagatgttactgtttatatgaaatggcttcctggtgaaacgcctggtggactttatgttactaataagatttatggagttgaaaatcatacctacgaacttcatatcaaatacaaaggaaaggaatatacagcatgtgagcggatggtgcctaaaactccaatagacaaaatagtaatgaaacgtattgatactggagaaggtgaacctaatgaaactccatgtatcagtttttataatcctcctgaagagcataactattatttgcttaaaacagatttttgttcttcaaaagtgcttcgtgtcgcatctgtttataatctatattatggaacaacgaatagtgccggttggccatattctattttggatgatgaatatttggcggaaaatgtgatagactatgttgtgagcgagggagagcagtttgtactccctaatcgtccggggtttagctatcctgtaagtgattccatttggataaaaatgcagtccatatctgaaaattgctatcaggtgtttgatcaaatgattaagcaaatacgttcggatggtggaactttctctccgcgtccgacctctgtaaaaagtaacattgataatggtgcttatggaatattccgtgtcagtgctatctctgaaatctatttttataagaaacataggatttgatggaaaaatacctgttattatttatattatcctgctgtggaaatttcaccatatgtaatgctcagacgattactgtcagaggtcgtgtgaccgacagaaaaaccggagaagtgctctcggatgctaacattggagacctgatgtcgagaacaggagtagctgccaatacgtatgggctatattccattcgtattaaaggtggacgttgtgtcttaagatgttcgatgctgggctatgtaacccaaatggatacgttgactctgactgcaaattcggttcataattttgctttgatgcccgataactatcaactaagtgatgtagaggtaatgggaaatcagaaagcaggaggacagttgacattgaaccagaaagatattcaggcacttcccactttaggaagtgaacctgatgtattgaagtcattacaatatcttccgggagtcattagtggcaatgaaggttccaataatatatctgttcgagggagtaatcaatggggtaacttgatattgctggatgaggcaatggtttataacccgaatcatgcattgtctttcttttctgtgttcaataacgacgctatacagcaagtgagtctttataaatcttattttccattgaagtatggtggaagaacttcgtctgttattgatgtcaaaatgcgcgaaggaaacaatcaggagaaacaccggagtgctacaattggagttatcgcttctaaaatccagttggaaggtccgataaagaaagggaaaacatcttatctggtagctggtagatttgcttatccgggagctgtacttaacgtactgaaacagtttcgtggtactaaaatgagcttttatgatgtaaacgccaaaattaattctacattaaatgaccggaaccggattttcttttcagtatataatggcggcgatcatactttttttaatcagctggtacgcggttatggcatgaactggggaaatactaccgctacttttcgatggaaccgcgtctggacagatcaattgtcgggaaacttcagtgctatttttagtaattattattatcgctataaatcaataacggatggaatgaagttcttgtggaaatcgaatatccaatcttatcaattgaagtatgatgcggattatgctgttaataatgcgttacatatcaggagcggactctctgcgcatgtgtttaccacaatgcccggaagtattagcagttggggggattttagtaatgttgttccctaccggatggacaggcggtctttattggatatggcagcctatggagaagcgacttataaaatttcatcggcatggcagttgaatgggggaatccgtttacctgttttttacactcctaaagttggagaactcaaacaaaagtgttacataatacctgaaccgagagccgagttgttctacttccccggaaccggaaaccgtttgcacgcggctttcacgcagtcttcacaaaacctgcatatgttgtctaattcctctgtgggtattccttctgatatgtggatacctgctaatggacaactgaaacctgcagtgatgaagcaagtggctttgggatatgagagaagcctggcgaaaggaatgtatactctctctctggagacttattatagaaagaccaaccatatcgttgattttgtagataatgcgaatatctttttgaataatcagatagaaacacagttgactactggttactcaaaggcctatggagcggaattttatatatctaaaaacagtgggcggctaaccggatggattagctataccttttcacgtgcccggaattatattgctactcttggagataaagaatatccgcctgtctatgatcgtccacatagcttgaagatatttctgaattatgaggccggacgtaagcggaggtgtgcttttgcagctaccttctcgtacaattcagggatgaatctgacattgcctattgctcattaccgggtgaacggtacagctttctatatctattctacaagaaatggttatcgtgctcctgcctttcatgaattgaatttatccatgacttgtaaaactggcaaaagaggtcgattgattctttctgtgatgaatgtatataacagaaaaaatgtgtttactatctatacgagtagagatgactatgatttctctgatattggcatgcataaaatgtatttgtatggtgcactgccatctatctcttatcaatttacattttagttagtttgaactatagtctgttattctatgtttttttgtacttttgcactcgttacaaccataaaccccgtaaagagtgatgaaccagataaattccgtatgcgtatatagcgcttccagtaccaagatagatgctgtttactttcaagcagccgagactctcggccgtctgtttgccgaacaccatatccgtttgataaacggagctggaagtatcggcctgatgtgctctgtggcagatgctgtgttgaaaaatggcggtgaagtgaccggagtgattccccgcttcatggtggaacaaaactggcatcatactggactgacagagctgatcgaggtagaatccatgcacgaacgcaaacagaagatggccaatttgagtgatggtatcatcgctttgccgggtggatgcggtacccttgaagaattgctggaaattatcacttggaaacaattggggttgtatctcaatccgattataattctcaatacaaacagatttttcgatccattgctcgaaatgcttgaaaaagcaatcgatgaaaactttatgcgacgccaacacggtgatatatggaaagtggcgcagacaccggaagaagcagttcagctgctttatgagactcctgtatgggatatttccattcgtaaatttgcagcgatatgataggtgatacactaagttcccagaacacggataccttgtctcttctccagcagaaacagattagtccggcaaaggcagacagtgatagcctgcagttggccgatcttcatgctgtacaagaggttgattctggctttgaaggaacccctatctcctactctccccgtacggacgatgctatcgcactgacattactggcttgcttctttctttcctctattgccttggcacgcggaaagaaatttctctcccaacaggtgaaagactttgtgttacatcgcgaacggacgagtatttttgatagctctacggcggctgatgtgcgttatctccttgtgcttgtattgcagacctgtgtcttgtcgggcatcacatttctcaattattttcatgatacatgtcctgctctgatggaccatgtatcctccctccttttgctgggtatttacgttggtttttgcctcgcttatttcttactaaaatggttgctttatatgtttctggggtggacgttttttgataaaaataagacaaatatatggctggaatcgtattctgcgctcatatattatgtcggatttgccctttttccgttcgttcttttcctggtttattttgatttgagtctaacgaatttggttataattgggtctattattttaattttcactaaaatattgatgttttataagtggataaagcttttttttcatcaatttagcgggcttttcctattaattttgtacttttgcgctcttgaaatagtaccttgtcttttactgtatcagggtatgattcaaatgaacaatattttgctaataaaattttaggacgttgaaaattaaaaaagtactagtgtcgcagcctaagcctgcgtcagagaaatctccctattacgacatagctgaaaagtatggcgttaaaatagatttccggccctttattaaggttgaaagtctttcggcgaaagaatttcggcaacagaaaatttcgattctcgaccacactgccgtaatattcacttcgcgccatgctattgaccattttttcactttgtgtactgaattgcgcgtgacaattcccgaaactatgaagtatttctgtgtgacggaagctgttgcattgtatattcaaaaatatgtgcaatatcgtaagcgtaagatcttctttggagctactggaaagattgaagacctgattccttccattgtgaagcataaaacggagaagtatctcgttccgatgtcagacgtacataatgacgatgtgaaaaacctgctcgacaagaacaacattcagcatacggaagctgtgatgtatcgcacggtgagcaacgactttacaccggacgaagagtttgattatgatatgttagtgttcttcagccctgccggagtgacttctttgaagaagaacttcccggattttaatcagaaagagattaagatcggaacgttcggatctactaccgcacaggctgtacgtgacgcaggtctccgtctggaccttgaggctcctacggtgcaggctccgtcaatgactgccgcacttgacatgtttatcaaggaaaacaataaataaacagagtgggtatatatactttgtgtaaagccgaaaggctgaatagtaaaattttgatcggaaagatgtttgaaggcggtgtttctaaatcgttttccatctttccgatacgcgttgtatatatgcctgtcgagcagggcgaggctcctgcttccatattaatcagtgtatcgaaacgtcgttttaaacgggcggtgaaacgcaaccgggtgaaacgccagatacgtgaagcctaccggaagaacaagtctcttctggtggatgaactgcaacgccgggagcaacggttagccgttgcctttatctatctgtcggacgagcttgttgctactgccgagctggaagagaaaatgaaaatagcgcttgcgcgcatctccgaaaaactattctcatgaaacctcataactcccggatatctaccgcgtgggtattcgttacgggaattttgagaaaggtattttccttcttcctgcttgttcccatctatttttaccggatttgtatttcaccccttactcctccctcttgtcggttcacgcctacttgttcagcgtatgcgctcgaagcaattaagaaacatggtcctataaaggggctttatcttgctgtgcggcgtattctgcgatgccatccctggggtggttccggttatgatcccgtgccttgagacaactgaaacgagaaatagaaaatgaaaaagaatgtgactgatattttagatatccatactcataaacaggaagttgatacccaaggaaaatccatcatcaattatccgttattggcagactctccattgtatatgcctctggcagagaatgtggaagtggctgtgggtagaggatcttattattctattggtattcatccttgggaggtgagagagagtaatgtcagtcagcaattgagctttcttcaacagcagctacagagaaagcagtttgtagctgtaggagaggcggggctggataaattggcaaaagctccgatggagcttcagttagcggtgtttaaggaacaggtaaagttgtcggaaaagctcggtttgccgttgattattcactgcgtgaaagcaatggaagaactgctgggtgtgaaaaaagaatctcgcccccaacaaccttggatatggcatggctttcgtggaaaaccggagcaggcggtacagttgttgaagaaagggttttatctttcttttggggaatattatcccgatgaaacgatgcagatagtccccgatgaacgcctatttttggaaacggatgacagcttgcttgatattgaagatatcctgtgtcaggcagccagggtgcgtggggtagaagtggaagcgttgtgtgaggtgattcgccggaatatccaaaatgtcttttttaaggcgtaagagttgtatcttccgagaaagagtcgtacttttgtcgcacatggaattgaaatacaataaaaaccaaataattaaagagtaatacgatgaattttgtagaagaattgagatggcgtggcatgttgcaggacatcatgccgggaacagaagagttgttaagcaaagagcaggtgactgcctacttgggtatcgacccgactgccgattcgctacacattggtcacctttgtggagtgatgatccttcgtcatttccaacgctgcggtcataagccgttggcactgatcggtggcgctacaggtatgattggtgacccttccggtaaatcggcagaacgtaacctgctggacgaagaaacattgcgtcacaatcaggcatgtatcaagaatcagcttgccaagttcctcgacttcgagtcggatgtacctaaccgtgccgagctggtgaacaattacgactggatgaaagacttcactttcctcgattttgttcgcgaagtaggtaagcacatcactgtaaactatatgatggcgaaagactctgtgaaacgtcgtctgaatggtgaagcacgtgatggattgtcatttactgagttcacttaccaattgcttcaaggatatgattttcttcatttgtatgaaacaaaggggtgtaagctccaaatgggtggttctgaccagtggggaaacatcactaccggtgccgaattgatccgccgtaccaatgggggagaggtgttcgcattgacttgcccgctgattacaaaggctgatggtggtaagtttggtaaaacagaatccggaaatatctggctggaccctcgctatacttcaccatacaagttctatcagttctggttgaacgtaagcgactccgatgccgaacgttatattaaaatcttcacctccatcgagaaagaagaaattgaagcattgattgccgaacatcagaaagctccgcatttgcgtcttctccagaaacgtctggctaaggaagtgactgtgatggttcattctgaagatgattataacgcagcagtagacgcatcgaacattttattcggtaatgcgacttcggaagctttgcgcaaactggatgaagatacgctgcttgctgtattcgaaggagtgcctcaatttgagatttcccgtgatgtattggcagaaggagtaaaggctgttgatctattcgttgataatgcggccgtatttgcgtcgaaaggtgaaatgcgtaaattggttcagggcggtggcgtttcgctgaataaggagaagctggcagcctttgatcaggtagttacgactgctgacctgctcgacgagaaatatctgcttgttcagcgcggcaaaaagaactattatctgctgattgcaaagtaataatgcatgattcattcgatagaatataaaaaagtgaacgaaatatttggaggtttgcttgcaaacctctatctttgcaccgctttttaagagaaagcacataagtttggactatggtgtaatggtagcacaacaggttttggttctgtttgtccaagttcgaatcttggtagtccaacgaagaaaagccctgaaagagatatctttcggggctttttctttttttgtggatgcaaagtcacttcttaagtcattagaacgttcacatacggaacaacaacatgatgatttctatagtttggttgcaaaagcggaggaagatgccttgaagaagtatctctctattaggatgtaagaaatttgttatagcttatttgtacgtaatattgactgtttcgatgtttgccttactcatctttgaatagacttctatattgttagcaacaatatatttacatttctataataaatccaaataccgtttttaataaatagtgagagagtttattaagaacggtatctgagtttattagaaactattttcagagaattattggaatatgtgggatttatatatacaaaatgggagaaaatcaatactgattttctcccattcggttcttccatatatggaaatatatgttttgataatgtgttattatgtcttgatttttatataactcatattgcttttttctttttctgttcctcaaagatacaaaataaaaagaggaaagtcaatagctaatcttattttaatggaagtataagcagaaaacgtgcgccattggtgtagctcttgtctactttgacttctccatgtaatcgttcggctatggtgcggcatatattcagtcccagtcctgatccctgtttgaactcatccaacttcttgaagcgttcgaatacactatccatcttgtcggcagggatgcccggcccggtgtcgctgacagagaacgtgattctgtcgggatactcggtcagtgaacaatgcagatggatttcccctttttctgtgtgcttctctgcgttggtaaggaagttgataagcacttgttgcaggcgttgttcatctgtggtgatctggaaatcgtctgccacttcggaggtataataaagcttcactccttccgcttttcgatccattacggtagagagtatgagcctgcacatttcgttgcaatggcaggaagtcaggttcatggtgtatttgccgctttccagtgcggaaaggtcaagaatatcgttgacaagcgtggtgagcagttcggagttgtgttggacgagcgagctgaattctagcttttcctcatcttccaatggcagatccgggttggataataattgtgagaatcctacgatggcattgagcggggtacggatttcgtggctcatgttctgcatgaaatgagtcttcatcttgtctgcctgttcggcacggtcgcgggcaatcgtcagttcttcgttcttctcttgcagttgtctgattgattttctgcgtagataaaggtagagcgtgagggctatggcaaagaaacagaagaatatcaggatgaatttcaatatcatcagctggcgttcggattctgcctgtttagctaccataagactctgtgtacgttcggtttccgctttgaattgtgcgagctccaggttacgtttttttagtagtagctcgttattttcggcgttcatcttctcgatttccacttgcgatttcgtttgctgcagttcgagcgttgtcttttgcaggtttaattgtgtgttttccagctgcaaggcttgcgcttttcttttcagttgttcgttgccgatacgcacattcagttccgacaggtcggcagtctgtatgagttggttcagagaatcctgtaaactctggagcttctgaagcgcttggtaagcgtctttgtacttctgctcttttgcgtaaatatttgcctgaaaagctattctctcatgtaagatagaggtggagtcggcgagagcatgcgctttatcatattgttggttgagtatataattgtatatcttcaacttattcagttcattccttctggtttcaccatgtttttcggtcgcttttaaacattcctgataatagcttttgaattcctcctccctgtcgagcgcgtataaaagtgtgcatttacgcagcatacaggcatatttgttggttgaagtcttggcacacttgattcctttctcggcattttcgtaggctgcttcatattgtttcaggttttgttggagcatggatatgttccagtatatataagatatatcctgctcagggagcttctcctgtgtgtataccagcgattgttggtagtaatccagtgccgtccggttttccctgcgcgcaaagtaaatgtttcccatcattcgcaggcaagtggagataccgtagggatagtcgtcggcaaatgcctgttctttagtcaattcagcctcctggagcgcacgcagggtattacctgtgttcatcaggtaattaactttgtagatgctgccaaagtagtaatattgcaggtagttgttctttcgggatatctcctgaagcctgctgattgctttctccagtaattccgttttcccattattgaaatagtagattaccggaatggtaagagcgaggcattgtgcctttttatcgttgatccggatggctttggtatagatagtatcagctatttccagtccggttgcgttgttacggtgtttagttgcctcctcataaagtagataaagagagtggtctatcttgtacggattgtcctgcgccttggttggaaggagagatccgataaaggtgaacaacaaacatatactgatatacctgactattttcatcttgattactatggatttacagtgttcttattgtttatttatggcattgttatattcgtattctttggcgggaatcacccacatccagttgttggcgtcttccgggttgatagttacggctgcgttggtcatgtagtttcctccgtcttcgaaggtgtggcgtacgatggtgtctttgcgccgtttgaagtcaaaccagctgaatccttcgccccatagttcgatgcggcggtagaactttatttcgtcgagcagtgcctgaccgctcttgtcgcaagtatattgagggtcgcgtccgctgtcgcggatcagttctttcagtaattgccttgcttccgcttcttttgaaggcgtcaggtggcagttggcttctgcttcgatgagatacatctccgaactgcggaaaagattgaaaggcatggcacctactttgtcgatacacttaaatttgaacgacatataagcgtatatttttgccgaagtattcaggtcgggatgcaacccttgggcgtaactggtgagtgcacttccgcccagaccattgtttgttataccacccgtgttataagtatattcgagcggatcgagaaaaagtcccctgcggatatcactttccggtaatgcatcgtactgttcacggttgatacaggccggataagtgcatacaagagtagaggaggagttgtatgcaaggcgtgcggcgagggatgagtttcccagcgattcttcttcactgtcatagatactccatatccattcgcggttgacggtactgaatccgtcgaaatattcatcggcattcataagcggataaccggcacgtgctagtgcagcgtaatgggcggcagtactccaatcctcacgggtgagtgcggcacgggcataggtggcgtaagcggcattcacattgattttgtgattctcgtcttctttgcgggcaattccggatgcctgataataggtgatggcctggttaaggtcgttgtaaatctgttcgtaacaggccagcatagaagaaagaggacagtcgccggtagaagatgtattgagccggagaaccaccccttcagcactgccgttttgcgaatcgcaccagcgtggcgagtagaactgcagcagttgcaggtaacaataggcacggtaggttagtgcctgcgcataaatatatttgaatttatgactaccttcggggtcgacataatttataatagcgttggcattactgattactttgtagtaataatgccacatatactccgtgtaactactggtaggtatggcatgagaagccccgttgaatatcgtatagaaattgttgcggggacaatacatgtcagccccctgatactcggcatacatcagtttgacagatccttcaccgttgaatgacacgccatcgagtttattagtggggtaagtggttttcatcaacttctccaatccgctgacagcataggcagcgtacgcttcatccttgaataaatcggcaggagatacctgattggtaggggcggtatccagatagtcgctggcgcaggagtaacacaacagcgtcaggagcaggcagaatcctatggagtgattcaggaatttcatgtgtatggcttttttcttcataaggctataagttaatgttgactccgaacgagaaaacacgggcgatactcgtataattgttgacgattccgtcaaaagtctgtaccgggttcagccctttgcgtttgctgaacagggcgacattctctatggcagcatgcaaacggatgccgccgagtgtcaatcgtttgctccatgtggcgggcaggcgataggagagggtgatgttcttgatgcttagatagtcaccgcttacaatatagcgtgtagatgctttctggctgttatatccattgatcgttgcatccagattcacttgcggaatacccgatggatcgagacggttgggcgatgtgggcgtcatgccttcggggattgctgtccatgcattcagtaaatcgggagtcaatgaatgtacgcctaccgatgtcagagtctgataaggctggtcgaagactttggaaccgcaactgaaaatcatcagggcggacagagtcaggtctttccagcggagagaggtggtgaccgagccgtttatcttcggtaatgaactgcccgaccagtctttgcgtgcatatctcgggtcgcctgtataatattgtccgttgatgtctacccaactgtctgtcggaatcggatttttaccttcggtgctctcttctccgtttacgggtgtttttccatcctctccggcaatgtaataagcgttgaagtccggcagatatacactgcgacctgtcatctggtctacgccagcatactggtacagccagaattcataaatgctgtgtccctctttgaacttctggaaatctccgttcgtaattccctcttcccgatctttatccggcagttttccgatcttgtttttcactttggaaaggttcaaacctacattccattcccattcccggttgcggatgatatccccgtcggcagagaattcccatcctttattggaaacgtctccaatgtttcgccagacggtggaaaggcctgtcgatgagtcagtggcaccggcagatagtggttggataaacttgaacagcaagtcgtccgaatgcttgttatagtattcgaaacttaggttcacacggttgaaaagacgagtttccagaccgatattcagcgaagaattcgtttcccattttagttccgggttttcgttctgcactttgtagtaagcggcttctccaccgttgacggcagagccgtagagagacatccactggtacaggccattactgcttccgaagttatcgtttcccacttgcccgtaagaaacccgtaacttgaggcggttcagccacgacacgtttttcaggaacgcttcgttggaaagcatccagccgatacctacgctccaaaagttaccccagcgatggtctgtatggaagatggaggaaccgtcgcgccggaaagaagcttcggcaaaataagtttcgttgtagtcataccgggcccgtgtgaagtgaccctctgtacgataggtgtctttatatccctcactgtaagttgtggtggtgaaatttgaaagttcgtctattccgggaaagctctcattctttttctgtatggcgtcgaaattaagcttgtaatcatagttctcgtgccccaccatccattctacgaaatgcctgccgaactggtgtttccatgccagtagctgttgcagggtgtattccttatattcctgatcgatcttgctgataaaaccagtgtccttgtaagcgcctatttccgcatttccgtattggctgtcctcgatattgcgcaggctgatattgcctttcaatgagaatgtaaaatcgcgtaggaaagaaacgtccacataggcatttccttgcaaggtattggcagcgttccacaacttgttcttttcgctttcccacagtagatggcgtccattgctggcggcatccgattccgaacggctttccgaaccgtcatcatattgttttccgccttcttcgttcaggatataatctcctttggaatgaagcaatgagccgtcgctggcaaatacatcctctgtatagtggaggtgcaccggatagataggtgctattctccgtgcaaagtaaaatgcattcgacaggttattggattgcgcacttccggcggctcctatatcccagttcgttttctggtgagtgcctccgagcgacaagcccgtttttagccatgggcgtggggtgaagtcagcgttgagtgagccgctaagacgattgaaatcacttttcctggtatatccgtcttcattaagatagcctagcgagaaacggatccggttcttttcattgccggattctccgcttaggttgtattcctggcggtgaccgttacgtgtgtagggagaataccagtcgagatcgtccttatatccgtccagtatccgggcgtcggatgccagatgaccgtttgcatcgaaaagggcattatcggctttgttatagatgttgattcctactttgctgataatgtcattgttggtggcgatggtcgcttcttcgggactactgccgttgctgataagctggttgcgatacccctgccacatcgtttccatgaattgattggcattcatacgttcgtaatcaccctgtccacgcgcgctgaagccgtggcgaatgtccagttgaagagaaactccctgtttcttcgcctttttggtggtaattaaaatcacaccattcgaagcccggctaccgtacaatgcgcatgaagcagcatctttcagtacgctgacgctttctatgtctgccggattaagatcggtgatccatcccgtatagggcataccgtctaccacgtaaagcggcttattgcttccgttcaccgaactgtatccccggatccggacttccgcttcgataccaggctgccccactccgtcaattgtctgtagccccggtactgctccgttgagcacggagataacagaactgaccggacgcatttcgatttgcttactgtccactacggaaacagccccggtaattgatcttttgaggacagtgccatacgctacctgcactactacttcatccagttcgttcacgttcggacgcaaccggatttccatcatattatgccgggcaggcacttcgatagtttggtatcctatgtaagaaataaccagcatttgctgtccggggagggttggttgaagactaaactttccatccagatctgaaatacagccttgccgactgcctttcactgtgacagaagcacctgtcaatggttcccggctttcctcatcaatgatgattcctgttatattttttatttgggcataagttaggttaatggatagaagcatgtaaatgcatatcactcctatctttattaaagtatcttctgtccgtcttttaataattgtcataagttgtatatcttgacgtatttgttgattttgcttgctatttaaacatttacaaaactaatatattataattagtgttataatacattgcctcctatttatgcaattttaacggtgtagactgctaattattagctgaattggcaaattagatactttttcttgttctatattttatattatttgttcttgcggctcgagagatagaggcttctttctttttttcattgcattaagtagaaatctctcccaaaacgtattatagttcgttaaaaaagtatacattgcacggattctggacatttttggtggataattggaacaaaattgcaaggtaaacccgttttcttttgctatttttgcatcgtgtacgtaaacgaagtgcacgtagaatagagaacttattcaataactataaataaataaggtatgaaaacgaactatgaaattcgctatgctgcgcatccggaagatgcaaaaagttatgatacaacaagaattcgcagagatttcttaatcgaaaagatatttgtccccaatgaagtaaatatggtatattccatgtacgaccgtatggtggtaggtggtgcgcttccggtaggagaggtgctgacgctcgaagcgattgatccgctgaaagctccgttcttcctcacccgtcgcgaaatgggtatctacaatgttggcggtcccggtattgtgaaagcaggcgacgcagagttcgaactggactataaagaagctctttatctgggttcgggcgaccgcgtagtgactttcgaaagcaaagacgctgctcatcctgctaaattctacttcaactcactgactgcacatcgcaattatcccgaccgtaaggtgacgaaagccgatgccgtagtagctgaaatgggttctttggaaggttccaatcaccgcaacatcaataagatgctggtgaatcaggtgttgcctacctgccagttgcagatgggtatgacggaactcgctccgggaagtgtgtggaacacgatgccggcacacgtacacagccgtcgtatggaagcctacttctatttcgaaattcccgaagatcatgctatctgccacttcatgggtgaggtaggcgagacgcgtcacgtatggatgaaaggcgatcaggccgttctttcacccgaatggtcaatccactcggctgctgctacccacaactatacctttatctggggaatgggtggcgagaacctcgactacggcgatcaggacttctcgttgattacagatttgaaataacaactacaatagttttcctaatttaataacaaaaagaattatgaatcagtttttgaatttttctttggaaggtaaagtagctctcgttacaggtgcttcttatggtatcggatttgctattgcttctgcatttgcagaacaaggcgctaaagtttgttttaacgacatcaatcaagagttggtagacaaaggtatggctgcttatgctgcaaaaggtatcaaagctcacggttatgtatgcgacgtgacagacgaaccggctgttcaggcgatggttgctacgattgcaaaagaagtaggtacaattgatatccttgtaaataacgcaggtattatccgtcgtgttcctatgcacgagatggatgctgctgatttccgtcgtgtaattgacatcgacttgaatgctccattcatcgttgctaaggctgttttgccggctatgatggaaaaacgtgcaggtaagatcatcaacatctgttctatgatgtctgaattgggtcgtgaaactgtatctgcttacgctgccgctaagggtggtttgaagatgctgactcgcaatatctgttctgaatatggtgaatacaacatccagtgtaatggtatcggcccgggttacatcgctactccgcaaactgctcctcttcgtgagccgcaggcagacggaagccgtcacccattcgattcattcatctgcgctaagactcctgccggtcgttggttggatccggaagaactgacaggtcctgccgtgttccttgcttctgaagcttctaacgctgttaacggtcacattctctacgtagatggtggtattcttgcttatatcggaaaacaaccgaaataatagctgatagaagaaattccggtaaggtgatagaatggcaaagagcatcctcttttcatctgtcaccttattttttattattccctttgcaggagctatatggccgatttattggacatatatgcccaacgtgttgaacatatagctccaacacgttggatatatatagctgacgcgttggagctatacatccaacatgccggatataatagcctctgatttgcaaagtatatgttattcattcaatgtagactaattatgagaaagatattaattctgtttgttgtagccttgattggttttgcttcttgtgccgacagcaagcagtcaatgacagtcacagtgaccaattctttggctcttgaacgggcaggggagatggttgaagtgccgatgagcgatgtggtcgctaaattgaaactggcggatacggcacagattgtggtgcttgacgtcgacggtcagcaagtgccttatcaggtgacgtatgatgagaaggtggtcttccccgttacggtaggggcaaacagtgcggttacttataccattcaaccgggcacaccggcaccttttgatgtcattgcttgcggtaaatactaccccgaacgtctggacgacgtagcctgggagaatgatcttggcggattccgtgcttatggtcctgctttgcaggctcgtggagaacgtggttttggctatgatctttttacgaagtataatactacggagccgattttggaatctctgtatgctgaagaacttaatcctgaaaagcgtgccaagatagccgaactgaaaaagacagatccgaaagccgcttccgaattgcagaatgccatctcttaccatatcgatcatggatacggtatggattgctatgccgtaggtcccacgttgggcgccggcgttgccgctttgatggcaggtgacactattatctatccttactgctatcgcacacaggaaatccttgataatggtccgctgcgtttcacggtgaagctggagttttatccgctggtggtccgtggagattctaacgtggtggaaacacgcgtcatctccttggatgcaggttcttatctaaataaaacagttgtttcatataccaatttgaaagaagcaatgccggtaactacaggacttgtattgcgtgaaccggacggtgcggttgtggcagatgctgcaaatggctatatcacttacgtagatcctacaactgaccgtagcggtgcaaacggtaagatatttgtgggtgctgcattccctgcacaggtaaaagaggcgaaagtggttcttctttccgaaaaggaaaagaaagatcgtggtggagccgacggtcatgtgctggctatcagcgaatatgagcctggttctgaatatacttattactggggatctgcctgggataaggcggctatcaagactcaggatgcgtggaataaatatatggctgaatatgcgcagaaattgcgtactccgttggcggtggcatattaattaatgtgctgaattgcttatacagtcaaaaaagaaggattgtcggggtgtgacgaaacgccctctttaatttcttttgctcactgaatacgcgattcattattgaatatcatgcgtcttttctaatagatgaagcaaaggtttctttttatcaaaggaacctttgcttatttttatctttctgaaaaagaaagagaattaagaatgtgtctttctggaaaagaaagataatgtccttgagctatcttgtaaaagcgtgttgttcgtaatattcgtatgtcgttccgtcttctttctctttctcacgaagttcatagactaattcattctctgtcattgtggtcactgtccacacttctgtgtaattatcctcttcagtgtcgatgagagtcagcttattaccggagtagctccatgtaccgtgataataattagtacttccggaggagttgtagacatctttttctacatacgtaccatcttccttgaactctatggaataacggttggttccatttacaaaatcttctttagagtcacttaccttttcaccatcttcccattcttgtgaaagataatacactccattccatgttcctaacaataaatcgcgtgaaccgacagcgtcatcgtcgtcatcgccacaggaataaatgctgaacgacagtaatactgcaactatgcaaacggttgctttccagattgttttcataataaattgttttaattgtttgattttgagatgatttgtttttatgggattatttgataatcgtttccacatgtccattcttgaagaataggtagaacgagctggaatacatccattgcacttctccatttgattcttgaatagtctgcggtttgccgaaggccagcagacattcatcttccgtcatgcctttcaccggcttgttgatactgatttcattccagtgagtgattggtgaaagttggttcgttacgatgaagtcgaacattttattcaatacttgcgattccacctgtacgaagtcatccatgatttctttgtgagatgctttcttgtccggttgcagcttctccatgggagtgatttttttcattatcactgctgatgattctatccgtatattggaaagatagtagaccagcttgccgtcttttacttgaaacagggctttgcaatagtaagtattcttttgatttgagtctgcttgcgaggcaagtatcagatcgcaactgaagtttttagccggcgcgtttacctccgttatcccttcccgtagctgcggacagacatttttgacggtccataacagtgcattagcgtagatgtttacatcttgcataccactgaaaggggtaaatccgctgaccacatatttattgccgtctgtactgacgggatagctctttttctgttcggtgaaagtctgtgctatcagcgggataactcccgtcagcagatacatgattgccagaaattgtcgtttggtcatcatattccgttatttttaagaaaacagcatccacggccctttttgcgaagagaaaagatcgtggacgctgaataaataatatggtttattgaggtttggttgtccttagaaggcaatacctagacgaatcataaagttactggtcttgaatccgtcggcatcgctgaatgtatctatgaatccgcgctgatagatgagatccaggttgaaacggtcgtaccagactcctacaccgatattcataccggcatcgaaatgattgtagtcaacttccatgtaatctgcgtaatctccccaactgatgctctctccgtctgctttcattttgctcgtgtaatcgtagctggcaaagactcctacatgcgggtcgatatgaacattgtccgccactgcaaatttccatccgaatgtgaacggagagtattgtatattatgagccatgcacttcgtgtcttccactttgaaaccacgggagccgagtccaaattccattccccagtatcctcctgtgctgcctaaaggcttctggtagccaaatgttgcgttatatccgatgtttgagtcagctccttcggctccgtcaccggagaagttcatgatattcaaacctgcacgcaagaaccattgtgtgctgctggcttgcttctctgttttgacgattgcacttctggatgatacgatttgcgcttgagttcctacgcacaataagagtgcggcaatcattgatagtacttttttcattgttatttatgttttagtgattaattcttattcttaacgacaggtgctatctggctttttccatccgtgggtgataacttctgcagacgtatccattcataatcgtcctgggtggcaggatgccagttgacaaagatgccgggataacctactactgtaaccgtgtatccccctgttttttcattatcttccactttgaaagtggctcccatgatgacatcgcagttgtatttgatggtggacagatacgtcccccatgcacggatgttgtcaagttctcctttcatggcgatctccacttcctctttgcttagtgtccattcatccttgattcgtcccttatcttccagtattttcacctcgacaactgtgggtttgacacaaacttcagtaactgcatcgcctgcacgtgcctgtgcatcacgaaacttgaagaccgtcttttgcgcatgggctccgacggcacaaccgacaaccagagcaataatcagaaatagttttttcgttttcatgtccttttgtgattatatgttaatatgcctgcaaaggtatgcgaaaggagtatactaccgggtgaaagcatagttccaagaacgatacggaattgtatcctatttggatacactggggaagtttccggtattgatgctgtcggaaagatcgcggaaaaaatcatggccgaggatgcaggagatgcgccagagcaggtggatgtcgatattctcttttcgaatatcttgtaaacattggggcgtgtgcagcatagttgggtagcgaaccaggtgacggtgcgtccctgttcgtgaagcgtgcgttcaataagttgtcccgcatgaatcatgtgcctattctgcttatgtgtgtcccccagactcccgttgggcggacaattcaatctattgttgacaggaatatatagaaaaggcgtgggaatctctcaccttcgtccgttccgtgttcaaggccttcgcaatgccaactatcgggaacgaacaacgcagaaagcccacgccgatatgtacaacacccgtagcctccctttgttttccaaagtgaggcacggatgtatataaatacacatcaggaggacgtctttgttgctgttagtcattccgataggtcaaagtttgcgaagttctgaacacaaatgacaaacgcttgtaaacgtcttctcaatataaacgtctctccctcgccacccggaggctttctgcggaagagaccgttgcaaatgtataaaaaaatacggttggaaatggtaatgtaaatcagaaactttttgaatgcaggttgttttgccctctttttgccctttttttgccctttaccaggcgaaatgcggttgcactggcatcttgtaagaaagaggagggatctttcaattttgggcacgaaacgggctttaaactacaaaagccggggcataatacctcggcttatattttttcttcttgtcagggagcttttttattcatcagaaaccttttctttcttatcaggaagctctgctcttttcgaagtttctgttttttcaaagattataacaccttgaattcataaccttcctctttcaggaactcgatggcacggggaagtgcgtattgcaggttaccgttgttccatgacttcagcgaatcgtggaaagtgatgatagaaccgtttcgcgcatagcgtttcacgttgttcagcacttgttccgggcgcatccgcttactgtaatcgcgggtcacgagatcccacataatgatgcggtaatgatagcgcaacgtatagtactgcctgaatcccatgtgtccgtgtggtggacggaagagatcggaatgaataatatcatctacctttctggcatttgccaggtaatccggattggaatattcaaatccacggatgtggttgaaagtatggttaccgatgcggtgtccgtgctctaccaccatccggtattcatccgggtgtttgcgtatattgtcgcctaccatgaaaaaggtagctttaatatgatgcttttccagtatttccagtacccagggagttacttcggggatggggccgtcgtcgaaagtcagatagactgcccgctcattcgggtccatccggaagatagcttgtggatacaacgcccggaaaagccaaggtggttgttctataaacatgagagtctgtgttttgaagtattaggaaataagtattaagtattataccttacggaaaacatgccggaagctacgttaatacttaatacttattacttcatacctaaattatttccctttcattctcgtcacgtactcgttgtatagctgatcgagttgcgtagagtaatgttttgcgagttcttctgatttgtatttttccattaggcggacttcggcgtcaagcaaactggcgttgtacacgaagttttcgctggcaatggcaagctggttatcgttcaggctaagataccagatcatgtattcgagcgacttgttggcaagctcgtcgataatcttgttggctttctcgttctgtcccagttgataataagactctgccatttggaaggcgccatttgcccagtcatacggtacgttgattgccggaatcatcttttcggcgtaatcgagtgcagcgagtgccttgtccttcttaccttctttgataagctgtcctacgagctgcgtgaagatacggcggtgcgtgtagcacatacgcatcacgttctcgtcgatgtagatacccggcttgtcgataccgccgaacttgaacttgttcatcaggttgtcgtacatcttttcactgtcgatcttgctgtccagcttgtccgtatcgaacggagtgaagcggtaggcgagaccctcctgtgtgaagtggttgcccatgcccagatggttttcgcttcctacggtgattgccatatagataggacgttcccagttagcgttggcaagcatttcgagcatcatcagctcactcttgtagagggcgcgtttcgggttgccgttggcgtctctaagggtgattgtcatgtattcggggatagagtcgcccagagcttccggtattttcatgccggagcggcgtacggcttccttatctatcttcatgacgatgctgtccgtagggatgagcggaagctgtatctcttttcctgtcttcttgagaagttctttcaattggtcgttcttgccaagcatccagcggttgatgatttccttcagttcataaggattctcaccgaagatggagtgaacgagcgacaatatggtagtgtctccctgtgcagccagttcgtttgcctgtttgaaatagctgtcgataagagctttcatttccggacggatagagatatattcgttttgtccttccacgtattccacacggtcccaagtgatagggagtgacggagaatcgtaggccggacgtttcatctggtctatataccagtctgtttgcaggtaacttaagttacaggtgcgggcatccgtacggaaaccttccgtttcctgattgtaccacaatgggaaggtatcgttatcaccattggtgtagataatcgggttgccttcttcctgcaaagtcatcaggtagttctgtccgaagtcgcgggcaacgaagcgtccgctgcggtcgtggtcatcccatgtctgtcccgccatctggatggggacgaacaaacagagcactgaagccagaacggctgccggaagttcctgcatcttggcataatctcgcaacatgcggatgatacctgccactcccatacctacccagatggcaaaggcatagaacgaaccggcatacgcatagtctcgttcacggggttgtgcaggagtttggttgaggtagagcacgatagcgatacctgtcataaagaacaggaagaataccacccagaattgctggatacctcgctggctatggtaagcctgccagaagagtccgattaagccgagaatcagcggcagacagtagaatacattatgacctttattgtttttgagatcttgcggaagcaattcctggttacctaccagtaggttgtcgataaacggaataccggtgatccagttgccgtgctcaatttctccgctaccctgtatgtcattctgccgtccggcaaagttccacatgaagtaacgccagtacatgaagtttagctggtaggagaagaagaatttgatattttcccattgggtaggcatgtttaccatcaccatctctccacactggtcgtaaggaacgtcatatcccttgatgtctacccattgtttgtagagcggtgcgtgtgacgaactgtacatacgcgggaaaagcatattctgtgcatattcgtattccacacgtccgggaagttcgatataagagtctttttcgtcgggagaagtcttttccttgcggacaaacttgcttcctgcttccgactggcgcggaatacaatagccgtcttttacgtcgagtgccactttcgaagagaaagcaggaccgtagaagagcggacgggttccgtattgttcacggccgaggtattcgcctagggtgaatatatcctccggtgagttttgatccatcggagtgttggcagtagaacggataacgatcagtgcgtaagaagaatacccgattacgatcatcatggtgcacagcagggctgtgttcatggtgcgggcggaaatgcgccatttctccttaatcttggtctgaatgttcggagcaagataaagacccagtgcagcgatgaccaagattccaataacaatactgctggctccgtgtccatagaacgggatacccagtagggcaatcgtcaggataaaggagatagccatgcgtgttttgttcttttcggtatagctttcgtatacaccccagatcagagcggctgcaagtagaataatataaaccactacacctgaattgaacgacattccgagtccgttgacaaacaacaactcgaaccagccgcctactttcacaatacccggtacgatgccgtaaagcacggctgcaacgagtaccattgagccgaataacgcaattaacgaacctttggcggtagcgtttggagttttcttgtaatagtataccagtacgatggcgggcagacaaagcaagttcagcaagtgaacaccgatactcaatcccgtcagataggcgatgaggataatccagcggtcgctatgaggctggtcggccacgtcttcccatttcagaatcagccagaaaacaacagcggtaaacagggaggagaaggcatatacttcaccttccacggccgagaaccagaatgtgtcactgaatgtataaaccagtgcaccgatcagtccgctacccatcactgtgataagctgtcctttggtgatattgttttcgtcagtgataatcagtttgcgtaccagatgggtgatgctccagaaaaggaacaaaatacaggcgccactcatgagggcactcatgtaattcaccattttagcaacagttgttacgtcggaagcaaattgagaaaacagattcgccactagcatgaagaaaggtgcgccgggcgggtgtccgacttccagtttatagccggtggttatgaactccgggcaatcccagaaacttgcggtcagttctattgtcaggcagtagacggttgccgcaatgatgaatgtaagccaacccataaggttgtttacggttctgtactgtttcattagcactatcgtagtttattcgttaaaaacaaattatgaggtcgcaaagatagtgatttgtaaggataatgaggaagaaagtaagaaatattaagtaacaaaggggtgatttactatctctttcaccctaagtcttgatttatttttctacttttgcttactgacaacaaatgcttgtgaagtaatggatgaaagcataaaactggaacaagagttcgatttggtcttcaaggcacattattcgctggtgaagaatttcgcgttgatgctccttaaatcagggcaggatgcggatgatatagcgcaggatgtttttacgcggctatgggccaaaccgcagatttggcaggacaaccccgggatagataaatatatctatgcaatgaccaaacatgccatttttgattttctcaagcataaacgcatagaacggtcttaccaacaggcacagatagaagagagccttttcaatgatttgtctccttcgagtgatgcactggacgctatttattataaagaaatacggttagctctgcaaatggctgtagaacaattccccgaacgccgtcggctgatttttgagatgagccgcatccagggaatgagtcatctggaaatagcggaaaagcttgatatttcagtgcgtaccgtagagcgtcaaatctatctttctctggttgaattaaaaaaaatcgtatttattttattttttcttcatttcatttgagtagtcttcgcatttgtgtcgtgctatatatgtattcaccactaatagcacaactatatgaagaattattttcggcagatactgacctcgttcactaagaatcattattcggaaacgatccggcagaatttctacggatggctgacggataaggaacatgccgtagagaaagacaaagctttaaaagaaatctggacagcggcgcgtgctatgggtgaagtgccccatgtggagaaggaactcgaacggtggaaacggaacaatggccttcatacggcttctccaatccctgcaactcctaaccgtaaaatccgtgtattgcgtctttggcaatccgttgcggctgtgttactgttggtagtcgtatctcttggttatctggtgatgcaggcggaaagaacgcagaatgaccttatacaggaattcattccggtggcggggatgcggcatctttctcttccggatggtagtcaggttcagttgaattcaaaaagtactttgttatatccgaaacagtttactgggaaagagcggtgtgtttacttggttggtgaagccaattttaaagtgaagcctgacaagaagcatcctttcattgtaaagtcggatgattttcaggtaactgctttgggaacggaattcaatgtcagtgcctatccggagaatcaggaaatcagtacagcattgctgtcgggcagtgtattggtagagtggggaaatctgacccagcggaccgtattgcagcctgacgaacagttgacgtatgacaaagagaaccgtcagtttcgggtagtgcatcccgatatggcagatgtcaccgcttggcagcggggcgaactggttttcaatgaaatgaccgtagaagatattatacgtgtactggaacgaaaatacaattatacgtttgtctacagcttgaaccagctgaaaaaagatcgtttgagtttccggttcaaggataaggcacctttagcagaagtcatggatatcattgtcgatgtggcgggcaatttgaaattcaagatagaaggagataagtgctatattacacggaaagggaataagaagtaaagaccggcgtgaaaccggaattgaaaatagccgaagtgaatcattcaataaatcaataacttaaaaaacacaattactgcccatgagaaaaaagtatccggaacagagcgccactccatcccggatatgaaataatcaacttttctgcatcagagtgttatgctctgttgatctgatctacgtgaataacaacctagttaacaaactaatacttaaaagttaatgctacaaaattacacatttatagcggataagcgaggtgtaagaagaagttttctactctttttcagcttatttttgctacaagtaacagcttttgctcaaaatgacgtgcggattaccatccgtgagaacaatattaccgtcattgaagcattgaagaaagtggaaaagcagtcgggattatccattgggtacaataactcgctgctgcgtgacaaacctgccctcaatctcaatctggataaagccggattggattattctctctctaccattctgaaaggtacaggctgcacctacgaattgaaaggtaaatacatcaagattattcctcaaccggcacaggaaaagccatcttccgataaacaaatcaaaggaaaagtgacagacgaaacgggtgagccgcttatcggtgtcaatattcaggtgcagggttctgccagtggagttattacggacattgaaggacgttattctatcgaagctccggtgggtagcacgctcaattttacctatataggctatactcctcaaaatgtgaaagtcacagatagaagcgtgtataatgtgacgcttgccactgccgtggagcaactcaacgaagtagtcgtgactgcccttggtatcaagcgtgaacagaaagcattgagctacaatgtgcaacaggtgaaagcggacgaaatctccggcattaaagatgctaatttcatcaacagcctgaatggtaaggtggcaggtgttactatcaacagcagttcctccggtgtaggtggagccagcaaggtagtgatgcgtggtgcgaaatctatcgaacaaagcagtaatgcgctttacgtcatcgacggtataccaatgtataacttcggtggcggtggtggaatggaattcgactcacggggtgctacggagagcattgccgacattaatccggacgacattgaaagtatctccgtattgacgggtgccgcagcagctgcactctacggtagtaatgctgccaatggtgcgattgttattactaccaggcgcggacaagtaggcaagttgcaagtgacggtgaacagcaataccgagtttgcccgtcctttcgtgcttcctgaattccaaaaccgctacgggacgggaagccgtgggaaagacggaggttctaccatcctaagctggggagcgaagttgaatgacgcttcccgcaccaattatgaaccgaaagatttctttgatacaggactgatcttcaccaattctgtcaccctttctaccggtacggagaagaaccagaccttcttttcggtggcgtcggtcaactccgagggcattgttcccaacaatcgttataaccgttttaattttactttccgtaatacgacgaatttcctgaacgatcggatgaaacttgacataggagccagctacatcattcagaacgaccgcaacatgacgaatcaggggatttattccaatcccattgtgcccgtttatctgttcccgcgtggcgatgacttcggacttgtcaaggtgttcgaacgttgggatccggcacgcaaaatcaatacgatgttctggccgcaaggagaaggtgactaccgtatgcagaatccttattggattgcttaccgtaatctgcgtctgaatcagaagaagcgttatatgctgtctgctcaattgagttatgacattactgactggttgaatatatcaggacgtgtacgtgtggacaacacgcacaccaagtatgaacagaagctctatgccagctccaatcttacaattacggaagagagtacgcagggacactataccatctccaagcccgacgaaacacaaacgtatgccgacgtgcttgccaacatcaacaagcgttttaatgacttctcactggtggcaaacgtgggtgccagcattgtgaacaacagatacgaagatttgagttatcgtggcccgattcgtgaaaagggaataccgaacgtgtttaatgtgttcgacctcgacaacacaaagaagaaagcccgtcaggacgaatggcaggaacagacgcaatcaatcttcgccagtgtggaagtgggatggaagagtatgctctatcttacactgaccgggcgaaacgactgggcttcgcaacttgccaattcttctacaccttgtttcttctacccgtccgtaggactttcgggggttatctccgaaatgctgactttgccggaatttatcgactatatgaaggttcgtggctctttcagttccgttggtatgccttatccccgtaatctgacatcgcccacttacgaatacgatgaggctaaccagcaatggaagcccaagacacactatcctatcaaggacttgaagcccgagcgtaccaactcgtgggaattgggactggatatgcgtcttttcaaggatttcagcctcggcttttcatggtacttggcaaatactttcaaccaaaccttcgacccgaaagtttccgtatcttccggttatagcaagatttatttgcagacaggatatgtgcgtaattccggtgtggaactctcattgggttatggacatacctggaacaaccatttgcactgggaaagtaatttcactctctctcacaacaagaatacgataaaagacttggtgaccagctatattcatcccgaaacgggattgcctatcacacagaatcgcttggatgtaggcggactgggtaaagcacgattcatcctgaagaaagggggtacgttgggtgatctttacacacagagtgacttgaaacgggacaatagtggcatggtggagattgatccttccggtgcgctgactactgaagacaacctgccggacattaagctgggtagtgtattcccgaaagctaatctggcatggaataaccgcttcgaatggcgtggtatcagtctaagcgcactctttacagcacgtatcggaggtattgcttattctgccacacaggcggcaatggatcagtatggagtgtccgaacgttcggcacaagcccgtgacaacggtggtgtgttgctcaacggacgtactcttgtggatgcgcaaacgtattacagcctcatcggaaacagtagcggattgccgcagtattacacttacagcgctacgaacgtgcgtctgcaagaagccagtgtgggttataccattccccgcaaatggctgggaggtgtgtgtgacatcaatgtctctgtggtaggtcgtaacctttggatgatttactgtcgtgcacctttcgaccctgaagcggtggcgaataccggtaattattatcaaggcattgataacttcatgttgccgagtacccgtaatatcggtgtgaatgtgaaaataaacttttaacccgttaaatcagatcgtatgaaacaagtgaaatctttcttaaagatattctccctgggacttctgctggtgggcggagcagcctgtacgggcaacttcgatgaaatcaaccgcaaggagtacgaagtgaccaaggatgagcagggacgcgaaaactacaatataggctctaccctgcgaggtttgcaagggttggtggtacctaccaaagagcatctttatcagtttatcgaggctttggcggcaggtccgtttgccgggtattatgggactacgctcgtgcgtaccgataaatttgaaacttataacccgtctgttgactggcaggataagacgtatggtgatatttttaccgaatcttatccgctttaccgcgatttgcaggatcagagcgatgatcctgtagcactggctcttgccaaattgctgcgggtagctattatgcaccgtatgacggatatgtatggccccattccttatagcaaggtgatagacgagcagggtagtgtttcgcttaatgtgccctatgattcgcaggaagctgtttacaagcaaatgttgaaggaacttgatgaagtgagttccgtgttgaaggaaaatcttacgataggttctgaagcattccgtaagtttgacgatgtttattacggtgacgttagcaagtggtataaatttgccaattccctgaagttgcgtatggctatccgcatggcgtatgttgatcctactacggcacaacaagtggcacaggatgccgtagatgcaggggttatcacggacaatgccgataatgccgaaatgaaggtggaggaaaaccgtgccgctatggttttcaacggctggtccgaccatcggataggtgccgacttgctttgttacatgaacggttatcaggatcctcggcgggagaagatgttcactcaagtggaaatcacggaaacagttggtggtaagccgacgaaagtgtccggctttgccggtattcgtatcggtattgatgtggtgaacaaggaaagcgtgatagaccgttatagcaaaccgattatatctactgccagtccttatccgtggatgaatgcggcagaaatcactttcctgcgcgccgaaggcgcattgcgcggctgggcgatgggaggcgatgccaagagcctatatgaagaagcaattgctctttcttttgaacagtacggacttcctgccacggatgctctttcttatgctgccaatgcttccaacacaccgcaggcttacactgaccctgtggatggaacttattcagccggagccgttagcaaccttactgttgcctggcaagagggtgatgaatatgccgagaagaatctggagcgtatcattacccagaaatggattgctatgtttccttctacggtagaggcatggagcgaatatcgtcgcacggattatcctcatttattgcctgtggtagtgaacaatagcggtggtactattgacgatacgaaagctaaaatacgtcgcctgtggtatccgcccagcgaatattccggtaaccggcagtatattctggaggccgtcggtatgttgggtggccctgataatggcgctacttctctttggtgggacaagaaaccgagaccgtagggacatgaaactggaaatgtgagaactagaaaacaagaagatatagaaactaaaacaagaagatatgaatatgagaatttccattgctaacatcttcactcatctgttcctgttgctggcattgcttgctaccgcttcgtgcagcgactggacggatcagaaaactgttgatattgatccgcagcatgccaaagaacagaatcctgaactttgggctcgttacatggagacgctgcgtacgtataggcaaagcaaacactttgtcacttacggtagtttcgacaatagtgccgaaaagtcgaagaatgaaggtgattacctccgttcattgcccgactcattggacatcgtaactccgacgcatcccgaaagcctgacctcttatgactgtgaggatattctcctgttacaggaaaagagtatcaaggtgctctatttggtggattataccgctcaaatgcccgccttgaccgatgctgccaaactaggtgcctggttggataaggccgttgctgccgcttcccagttgggtatgaatgggtttgccattaaaggtactcctctttatggaggaacggaggctgaacaggctgcccgtcgtgaagcagccaaattaatcgtctccaagctttctaccgctgtaggcgatggcaaactgttggtatttgaaggtgatcctgcctttatggatgccgcagatctgaataagctggattatgtcgtcttgaacactgctacgattacctctgccgtagatttgaaactctatgtggcaggcgtgatagaaaacttctcaatccctaaagagaaactattgctctccgccaagattaatgaaaagctagtggatgaagaaggtgaaaaactggacgctgttaccgagatgacaaaccgtgttgtttctttgggtcctgtaggcggacttgctatctatgctttgggtgatgattactatcatacgaagatgaattatgagactagtcggctagctatccaaataatgaacccgtccaaataaggggcataactaagagattatttattgtgaaacctgtaaaacactataatgatatgaaaaataacccatttaaatacttcgtctttctgatgctgtcactgctgatggtagcaacgacggggtgtactgaagatgatatttccatgcctgccgggcagttgccggacgaaacgccgatgaatagcgtcggagggcagttatgcagtggaaaaactttttctaataagattactgtcagtatgtacgaaggtgatggagctgtaaccgaagagatatgttatgcactgacaaagcctgctataacggctgttacggtaaaagccattccgtctccggagcttgtggctcaatataacagtgacaacgaagctgatatgaaggaatttcctgttgctaacgtaactttgggaaatggcggttcgcttactgtggctgctggaaagaaagaatccggaactatcagcataactctttctcctgatggattgaagcctgaaacactttatttgttagcgattgctttgacacaaaatccggtaggagtagatgcacaagagaataaacaagtaatttattacagagtgaatttcagggaaaaaactactatgtgtgaacctgatggagaggggcaaacacaagaaatcccgccactaatgtctggtgtaactacagtgttttatgtgaatacagaaacgtatagtcctttaatagctggcgtattggcaattagagatgatgggttataccctcctcctccttataatcgcttggggcatatcgtaaacttgaaaagagcaacgataggttacgatgctgttagccagcgtgctttgctcgcacctggaagtgacctgtcttacgtattggagcatagagataaatacattcggcaccttcaggaaattggcagcaaagtttgtatttgtattgaaaatggtggtaaaggcatcggcttctgtaatatgaatgatgcgcagatagcagactttgtctatcaagtgaagagtataatagaacattactatttggacggtgtaaatttatgggatgatgatagtaaatatggcaaagctgggatgtctgcaatgaacactacttcatatcctaaactgataaaagctcttcgtgaggctttaccggataagttgttaacgctggttgataaaggagatgctacggaatatttatatgatgtaaataaatgtgggggaatcgaggcaggtaaatatcttgattatgcatggcatggctacttttcgccaacagaagtggtagaagccattacccctaaccccgagggtactcaagtttatagcaaatattctcgtaaacctattgccggactggatcctgcttgttatggaagtgtaaatataccttgttattctgacaataatcccactataagaccgcttgctgcagagaatatagctaaatggaaggctgcaggatataaaaagagcaacatcattgtttatggaggtgaccttatcggtactgaatatggaggctatgaaggagctgttaagaatatgttgactgagtatagttttcagtcatttatggatgagggtgatagctgggattttgtaaatgatgagcttctatggggaaatgctctttatggggcaaattttctggactatcaattaaagtttggtcctgataagaatccatatagaaaagactggtaaatcttcttttgaatattatcaataaatactttttccataaataaaggaaaaattcgttctttgacatattgaaattaccgttgatagttgtcatttgcagtggattcttttcgtaaaaatgtaaccgcaatctaaacttattgattacttttgaccccgatatataatatgaatagttcgaggctatttataacagacatacaagatggatcaattgcagataattcaaaatagaatatatgagtttagaggtcagaaggtgatgcttgaccgtgatttggcagagatgtatggagttcagacaaaagtgcttaatcaggctgtcaaacgaaatatagaacgttttccttctgacgttatgtttcagatttcgagtgaagaaacccaagattggaggtcacaatttgtgacctccaatgctataaaaatggagtaagacctaatccgtatgtattcacagagttgggtgtagccatgcttagcagtgtattgtatagtaaaagctttaatggtgtatcagacggtaatttcgatatgtaaatttgccgtcttttttgtgttcggacggctatataaatagggcacataagtgatttatgtttttgattaaacttaatatacgaactggtatgaaaacaaaaaaaatacttcgaggtatgcttactatcatttcaccggctatcataactacggccctgttgttatgtgccatcggctgtgataataaagactatagcaatgcctcccctttcgataatgtcgtctatttggatgcagccaagctaaaggacgtgtccaactttacttttaaccgtaccatagagacgggacaaaaggaaatttccgctttgttggcacgtcctgcaggcgaggatatcaatgtcggtattaaagtagacgcctcgctggtgaatacttataacgcccgtcttggtgctaactataccatgcttgatgccaagcattacaaactgtcggcaggtcagactgttatcccgcaaggtgaagtcagctccaaacctgtcactatcgacttctccggtcttactgaccttgaaattgatgcaggctatttgctccccatcactatcgaccaggtgtcgggtggtatgggtacactaggcggttcaaagactatttgttatgtggtacgtcgttccagtgccatcactacggctgtcagtttgaaaaataatttctttgaagtgccgggctttgataaaggaagttccacggctgatgtggtgaataacatgaagcaactcacctacgaggctattatacgtgtgaataactttaagaatggtgtaactgcaagagaaatatctacgattatgggtatcgagcaatattgcttgttccgcttgggtgatgcaggttttccggcgcaacagttgcaattctcgtgcaatgagattaaatttccgaacgctgataacagcaagcttttgcaagaaggcgaatggtatcatgtagcggtgacgtttgatacagaaaagaaagtggcggttatctacgtagacggtcgtgaacagagccgtattgaggattatggtaaaggagaacctattaatctgggtatgcagaatcgtggtaaggatttcatgttcaaaatcggccattcctatggcgaacctaccgatttctcccgccaactcgatggtgaaatctgtgaagtacgtgtttggaacgtgatgcgaacccagcaggagattttcgataatatgtataacgtagatcctgctactaccggactttgtgcttattggaaatttaacgaagggcatggtgacattgccgaggattataccggacatggaaatgatgctcatgtacatacatcgcctgctgtatggccgcaaggcattgaggtgacgcagaagaacaaagaatagttttggaataagagaatagaatgataaaatgccccgtcaagcagaaatgtgaattgcatttctatgacttgacggggcatttcttttcggaccttaataaataagccctgatgtattagagataaacttcctttatcctgttagtgaacttcttttgccttaatagcaaacttccttttcattagtcataaactataattgcaagttttgtttttataaacgcaacttgcaattataaaaacaaagcttgcaattttataaacgtaacttgcgtttatagattatccttagtcaagcataactttgctattggagaagcggaagtttgctattaatagcttggccgttaggtgttaacacttgagacatcagctgaagttagagattgcttggtattagatagggaatgaactaaaatacatgggttcttgtttccaaaataggaacgttttttgtatctttgctatgtaaacacaaagtcatggaagagaaagcaaggtttaatgtaaaatatatggaggaaatgaaactttatactcatgaagaaatgctggatagagtgataggtacaaaaggtactccagcacgcgaaaaatatgagactgatattaataactttcttataggtgaggctattaaacgggcgagagaggccaagaatcttacccaagaacaattaggtgagcttatgggggttaaaagggcacaaatctcgaaaatagaaagtgggaaaagtatatccttttctactattgtaagagcattcaaggcaatgggcgtgaaaacggcaagcttggaacttggttctttgggcaaagtggctctttggtaaatactatttttgtcttacctaataaacagtaacctatgtctgttgatgttataaagcaggaactattgtcgaaattgaagcaggaacattgtttttggtcgtacaatgaagattcaatcaaagatattccggatgatatgctgattgaaaaaacgttgttgcatcttgatttagaggaaattaatcagctttttttggtttatcctttcaagaaaatcaagcaggtatggctggattatctcattccacaagaggaatatctctatacgttgaaccgtttttttgcatggtactattttaaagcaaagaaaccggacgcttatataaaatctatggctactcgtcgcctaaacaaaatacttctatgaaaggattagctccacacacactgcagatttttgaagcggtttcccaattggattgcataaaaccttatcttctggtcggtggaactgccttgtctttacaaatcggaactcgtcagagtgaggatttggattttatgaagtggcgcacttccaagatagagaagatggaggtagcttggtatcagatagagaaagaactagctacgattggagagattcagcataaagatattctggatatagatcatgtggaatatcttgtgtcaggagtgaaattttcgttttatgcttgccctaaatattctccggtaagtgagccggtaagctacctgaataatctgaaactggctgatgtgaaatctatcggagcaatgaagatggaagtgttgttgcgtagaagcaactttcgtgattactacgatatttactccattttaaaatccggtgtgcctgtcaatgatttaatatctttggctttaagctactccggacacaggctgaagtctaagaaccttttggcaatgcttactaatagcaaccgctttacgagggattcccattttgagcagcttgaacctgtttatgatgtgactgcacaagaaatagagggctatataaagaattgtttgctctaatttgtttgcacgaatctaccaatgaacttttttgcacaaatagattcatgtaggtcgtcttttgcagatatctttaatgatggtgatgatgctctcctaaaacccggtgaggcaatgtaccgtgtcccaatagctcgatagggcagttgaagttcctttccagccattcggtagtaacgcctgtatccggatggtaatccagcgtttcgttgacgcaagcgatagattttacctgttgcaatacagtgccgatgtcgtgactgacaaggataatggcacattctttattgatttcagccaataactcataaaggcgtgcttcgaaacgcttgtcgatatacgtgctgggttcatcgagaatcaataccgcagggtcggagatgatggcacgtcccaacagggcacgttgcagctgcccgccgcttaattgcccgatagaacggtgttcgagtccttcaagccccatgcgggaaataatctgtttacctttctctttctgttcgggagtaaatcgtgaagtgagcgatttttgtatgcttaatccggataggatcacttcttccacggaaatagggaacttccggtctatactgttgtattgaggcagataacccaggaaagtagaagtggttttagtagatgctttttcaggagtatggaatataatttcccctccggttggcttcaacagaccgaggatgcactttataagcgtcgttttgccgcctccgttcggacctataatacctagaaaatcccgttcgtagatgcttagattaacatcgtggagaacagtgcgaccgtcatatccggcggaaagattctttatttcgattattggtttcatcgttggaaatggcttgatgggttctttctttatacatttattttgttgcagcctgtggcgcgagggctttggctacattcagcatttcttcttcccagtcgtaacttagcggattgatagggatcactttcgtttcggtttgctgcgcgatggtttccgcattgcgtttgtcaaattccggttgaacaaagattacacgtacatcttctgcctgacacaggtctatcaaggctttcagatgggcgggagaaggttctttgcctccttcttcgatggaaatctgatgcaatccgtagtcgcgggcgaagtaggagagagccggatgataaatcatgaaggctttggctgcttcgggaacggagagttgacggcgaatcaggctgtcggtgtgctggatacgctggcagagcgaatcgtagcggtttctatagtatacctcatttgtcttatccagttggctaagggctttgtaggtgtttcctgcaatgattaaagcattaccggtggaattccatacgtgcggttctacggcgtggatatgcccgtcgttactgttatgtccgtggtcgtggtcatcattgttgagtatgaggtcaatccctttggaggtgtcgaacacttgaatatggggggtattgttcatcaaacgatccatccaggtctgttcgaatccgatgtatccgatgcggaaataggctttgctgtctcccagagaaacaagttgttgggggacaggatcataggtttccgggctggaacctttggggaccatgctgactactttaaatttatctccggcaatagcttccgtgaaataacgttgcggttccagggtgacggtaatcaccggttttgcttcgtcatcgttgcttgcttgggaagagcgtcctgtgcaggctgccattaggaggcaggcactaaggaggaaaagggttctcatatcttttagttgttttttcatgacttcttctatttcgggggttcttttttatcttgtttctattcttattttcgggcccgtaatatttcccgtttaccacccggaggtccgggcagacgttctactgtgaatccggctgtctgtaacatccggcggacgacacctttggcgcagtaagtggtcaggatgccgtctctatctaataaaacgtagaggcggttgaatagttcttgcgaccacatttccggttgcttttccggtgcaaaggcatcgaagtaaatgaggttaaatgaaagattcagggcaggtgattcggcgttggttacgctatcattgatattgctcattgttcgttctctgttctcaacccatttgtttacgtctgtctctactttccgtagggtgaagtgtggagtgagttgcacgtctttctcccaaggtgatgtatgaagttgcttaaacaattcgatagccggttgctgccgggcggtcgtcgttaattgttcatcattggagatatatcctaattgctctatcgtctgccattccagtggatagagttccaatcctgtatagtgtatattccgtctgcttctttctgcttcttcaagggtgagccaggcgtttagccctgtcccgaagccgatctcaagaatatgtggagtagtggcggaagaggctttaagtcccatatcgatgaaaatatgttgagactccgtgcgtgcccctttcgttgaatgataatgttcattcaattccggaacaaacagggtagcgctcccgtcgtcggttttctcaataatcctttccatcatacaatctctaatgcttactgtctaacgtctaatactttttacctgatatttaaaatccttatcctgctatagcgtcccaggcactttcgagtgcatacaggagaagaatataacgtatcagtttgccgacaaacatggaaactatggtgagccatgtgttgcttcgcataaatcccagtgcaatggctatcacttccccaatggcgggaagaaaggtgaagaaggccatcaatgctcctttcccttgcaggaatttcaccattttgtctactttctctttctttaccttgaaatatttctcgatccaactgattttgcccagacgtcccatgtagtagcaagtcattccgcctactgtgttgcccagagtggcggagatcagacaggctatcgggggcagaccgagtttcaccagtgccaccagtaccagttcggaactgaaaggcacgatgctcccagccagtaaagccgagatgaataatcccgggagtccccattctatgaggagttgtatcgttgaatctataaaagcgtccatatattaaaagcgaataagaggatgagaccgaccaatgaaatgatgaaaaacacattcgaacttttactattggtcagtacaaagaaatgtccgatcaggatgctgttgcttatgataagcaaaggcaatagggcactgcaatatatcggttgcagggcaatcagcaggaacaggaaaatcgtcaggtctatcaggaattggagataggcgcgtgtgcgtatcttatcctcaaatccggcggcgatgcaatggacggcactgacgatgaacatcaccaacagatagccgagtattgccagttcccaaggctggaggatttgcaggttgaagaattccccgatagtcagtagctgattgaaagggcgatagaacaactccatctcattgtagaagaaggcgtgtccgaacagcatccagtatggcagcatccatccgagcagcgcaccgcagaaactacgcggagtgagcgactggaaacggtaggcttcgagcaaccaaagcaccgagaggatggtgaactgtgggaacagaatacttcccgctccgataaagaagaaggagtagaataaataacccgcagcttgtgtttgctgatagcttttaaacagaaaataaatggaaatgagaaagcccagggcaacaatatctcctgtatataggtaatgcattttcgggcagacggtgaccagcaggaaatagatagccgtctgcatggaagccctcatacggataatgctgaactgattgttcagctctatcagaaagtaaccgatggttgcataaatcaggaagctgacaatccggtctgcccaccccggaagcagaaaatcgcgggcgggttgccaggcagaagggctgccttcgagtacggttgaggctatggaaccgggaaataaaaagtaagtcaacacccagcatagggcgcagataaagataacggcaggcagggtccaccgtcctgccgtcacttgactttgtagtcttttatttctcatgagtttattacttgttatctcttgatactataggtacattcggttgatattccggatattaatatcctgcatgcttgatgttaacaaccatcctgtcagctgttaatacctgattccttaagtattaacaattgtcgtctaaactattaatacttgataactcaactattaatgcttgacaagtcaatgatgttcaacgctatgcggaatagggctacttgcgtgcgaaacttgaattacaaatcgaatccgatatcgcggcggaaatacttcttgtcgaagtcgatcatgtctgccactttgtagctctgtgccagtgcctcttctttcgttgcaccgtaagagcaaacggcaatcacacgtcctccgttcgtcactacttgtccgtctttcatggctgttccggcatggaaaatgatactgtcggtagcggcagcctgttccagtccgctgatagggaatcctttttcgtaggcttcgggataaccgccgctgacaaggatgacacagccggctgaacgtgggtccatcaccagtgttttttcgttcaggttgcctgcggcagtaccttcaagcagttctacgaagtcgctctggatacggagcatcacgctttctgtttccgggtcgcccatgcggacgttgtattcgatcaccatcggttcacctttcaccttgataaggccgaggaagatgaagcctttgtaagtgatgttttcttctttcaggccgttgatggtcggttcgatgatgcgtgtgcgtactttctccataaatacttcatcggcaaacggaacgggggttacgctacccataccgcctgtatttagtcctttatcgccttcaccgatgcgtttgtagtctttggctacggggaggactttatagtgttctccgtctgtcagtacgaatacagagcactcgataccgcttaggaactcttcgattacaacggttgccgatgcagagccgaacatgccacccagcatttctttcagttctactttagcttcgtccagtgtagggaggataagtactccttttccggcacaaagaccatcagccttcaatacgtatggagcttccagcgtttcgaggaaagcgagaccttcttcgaggtttgccgaagtgatgcttttgtagcgggctgtcgggatgttgtggcgcatcatgaagcctttggcaaactccttgcttccttccagttctgctccttgagccgaaggaccgataacggcaatatgctttagctccggacggttctggaagtagtcgtagattccttctaccaacggatcttcggggcctactactaccatttgaatgttctctttcagagcgaaagcgctgatggcttcaaaatcggttgctttgatgttgacattctcgcctacggcagttgttccggcatttcccggagcaatgtacagtttttcaactttcggactttgggcaattttccatgccagtgcatgttcgcggccgcccgagccaagtaataatatcttcatctttgtattgttatggatttatactgttatctatgattcgtatggatacggtggtgtctttgtcagttttataagttctgctcaaagtaccgggtgattttctcatgcagatgtacacggtcgcgtcctgctacgttgtgcttgtggcacgggtagataaacaggtcgggataagtgcgggcatctacacaggctttcatgaacgacagggtgtgttgtggcacgcaggtgtcgtcgtggtcgtcgtgaataatcaataggtgacctttcagttggtcggcaaggtttttcagattacattctttgtagccttccggattgctttccggtgtgtccatatagcgttcgccgtacattatttcatagtaaccccagtcgattaccggacctccggcaacgcctactttgaatatctccgggtaacggagcatcagggcggtagtcatgtgacctccaaaactccatccgtgtacgccgatgcgctcgctgtctacgtaggggagggatttcaggaattcaacgccttttacctggtctttgccttcttcgatgccgagacggcggaaggtggcattttcaaatgttagtccgcggttgctgctaccgcgattgtcgatggtgaacatgatatagcctttgcttgccatgtatgtgtcccatccgcgtgcgccgttctgccatcctccggtgacgcattgcgcgtgagggcctccgtagacatatacgattacgggatatttcttagccggatcgaagtttgccggcttcatcaggcggtaatgcaggtcggtagtgccgtctgccgctttgattgttccggtttcgatgcttggcatctggtatccgtcgtaaggattttcggctgtcagcaagttggctgtttctttgaagtttttggtgtctaccaggttgatgacgcggggttggtctttggtggaataacggtcgataaggtatgtgccagaggcgctaagtgttccgctatgttcgctttccttgcagttctcaaacggctggcttatctttccattacttacgtttactgcaaaatggccgcttctcaagccttctacggcagtgaagatgacctctttacgctttgtgttgaatcctaggatttcgctgaccagccagttgcctttggttagctgttttactttaccggcctggaaataactaccgccgttggcactattataggtttcacctttcatgtttgctgcatttgtctcaaagagataaaggtgattgtagccgtcacgctgactttgatagatgaacttggtagggtcccacggcaaaaatacgatggggttttgcggttcaacgtatttagggtgcatttcttcatagagaactcccatgggttctcctgtctctgcgttgtactggcagagtttggcatgattctggtcgcggtttacttcgatcaggtagaggctcttttcatccggtgcccagctgatgttagtgaaataacggtctgtcggatcgcctgcattcagataaatgcttttaccggtagcagggttgtaaatgcctacttttacctgatggctcgtcattcctgccatcggatagcgtacgttatttacttcgcctacacgtgcagtgatgtctacaagcgggtattgtgtcaccatgctttcatccatacggtagaaagcgagcaggttgcctttcggactccagaaagttcctttgttgataccgaattcattgcggtgcactgtttgtccgcaaacgatgccttcgggttcattggttactgctttctcattcacatatagattgttatctatcgtgtaagccacatttccactggctgcgcaatagtcttcattatttgccccgtcctttggtttgaaagtgctgacaacctgattgttcttgaaattatatacaatgaactttcctgctatcgtgaatagcatttgtgccttgtctgtccatggaaaacggacggaatacaggtgtgataattttcctgccttgttttcttcaagcactttgttgatttgctcgcgagtgataaccattgtttctttcccggttttgggttgaattgaataaagggtatctactcctggcttgatacattcgtcgccccaccattgcagcccgtacaggttttctgcatagaggtaactctcgccgcccggaatcagttcttccagcgtcggttttttggtttcttgtgccataacattgaatccgattggtagtgccaacaataacagaatggctctttttccaattttactcattgctcttttctttattatttgtttttaaatccttctatttttactctgtccaaaggagtctgtcttgattggataattgcacttattttagcaaaggcattaaataggtcgtcaaattgtttttcgtaactttccctatcagaagtaatatcttcttcgagatattcgatgcgttgttttaattcttccaactcctttttaggtatattggatagaagatattggcgcatacgtacaaaagcacggataatattgatatttacttccacagcggtcttggacttgaggacgctggataacataactataccatattcagtaaatgcaaacggaagatatttgatgttatatccttgtcctgttttcaaggtcgcaatttgcgaccttgaaattgcaacttcttcttttgttagctcgaacatgaattcagcaggaaagcgttcaatattacgacgtacttgttccttgaggcgtttagtttcaactccatacatttctgccaaatcaaagtcaagcataactttttgccctctgatttcgtatattttgttttctataatagctatatcatccatttttttgtttagacaggttccaatttgtgactgaacattagaactatgatgtaaacttgaagttccaatttggaacttcaagtttttaattaattattaactagtgaattacagggtgaataagttgttgggattataaccgtttattcctcttccttcttcggaatcctcggctcccggtttcccctaaattctcttggccctcttgaatctcttcctccgcggaattctccccgtggttttctatctttttcatcgccacctttgaagtcgccaccttctctgcgtggcttgtattctccctctctgcgaggtctggattcgccgtcccgacgcggcttgaactcaccttcgcggcgtggcttaaattcttttctttctctgaatcttggagcttgttctccttcaccctctttcttctcttcgccctcttcctggctcttgaactctttatattttccgtcaaaaatctcatatttgcggaattcacactccaacggtccattgaacaaaggaaccttctggcttgccttcaagccaatctggtcgaaacactcttcccgataagaaagcacccatgcttcgtttcctacaaatgcatgtttcagacgttcgccgatcatctggtaaagaccgagcaaatcattcgtagagatacgttccccataaggaggattggtgatgatgattgatttctctttcggctgttcgaactgctggaacggttgcaatttcagcacgatatctttcgatacaccggcagcttttatattgtgagtcgcaatctcattcgcttttggattgttgtcgtatccgtaaatcttatgagcaaattcgcgctcctgactgtcgtcattgtagatctcatcgaacatatccgcatcgaaatctacccatttttcaaaagcaaaccctttacggaatactcctggagcgatattcttagcaatcagtgcggcttctacagggatagtacccgaaccacacatcggatcgatcagatcacattctccacgccatccggtcattaaaatcatgccggcagccaatacctcattcaacggagcttctaccgcttcctggcgataaccgcgacggtgaagtgattctccggacgagtccaacgacaaggtacaggtagtctgtgcaatatgaatgttcagaagtacatccgggttgttgatgcgtaccgacggacgtttacccgttttctcgcggaagtagtccacaatcgcatctttcaccttgtacgaaacgaatttcgaatggcggaactcctcactgaatactactgcatcgatagcaaatgtcttgttcacatcgagatattcttcccatggaatagcctgtatttgattgtaaacctcgtcagcatctttggccgtaaagttcttgatgggtttcaggatacggatggcggtacgtagacagaaattagccttgtacatcatacgtttatctcctgtaaatgaaaccatacgacgtcctatttgaatgtcgttggctcctaatgctgtcagttcttctgcaagtatctcttccagtccctggaaagtcttggctatcatctcgaattgttcgctcatatagattcttttgattttatttttttgctttagtttgtacgattcttgctcctgcgggcacgttttccgttacccagatattaccgcctacggttgcatcacgcccgatggtgattcttcccagaatagtggcgttggaataaacaattacattgtcttccaggatcggatggcgggggattcccttgataggttttccgtcggcatccagcgggaaactcttggctcccagcgtgacaccctgatatagtttgacgttgtttccgatgatactcgtggcgccgattacgacacccgtaccatggtcgatggtgaagtgagtgccaatctttgcggccggatggatatcaattcccgtttcgctatgcgccatctccgtgatgatacggggaatcagaggaacacccagttccagcaattcatgcgcgatacggtaattgctgatcgctttaatggccggataacagaatatgacctctccatagctttcggcagccgggtcaccgttgtaggcggcttccacatccgttgccagtatcctcctcatggcgggtaacttactgatgaatttagcagcaagacgtgcagcttcttctcgtttggagtcggagcagacgttgcatttcccctctatggaagtgctaaaacataatccggccaagatttgctcacaaagtaaatcaaacaatttttcaatgttgacaccgatgtgataattgatagtccggctgttaatagtagaatttccgtaatatccggggaaaagaatggagcgtgaaagctcaataatttcatacaagacttttgcagagggcagtggctcgccatctttgtgctgatgaaacagtcctttataagattcgctttccgatagctcatcgactgcctgtgtcaaaatgtgggtgaagttcagtggactcattaggtcagttgctcatatttatatgggcacaaaggtattaaaaaaataataaaattcgctgggattcaggataaataatgtatttttgtcacattcaaaacatgacatgaataaggggactgatgaatcagaagactgctatgaaactatttggactgttggggttgttgatgttgttgagttgcggatatgctgatagacaccgcaatagctctttatgcgaacaggcgttggttgattctctggaagttcgtgtacaggattctttgttttccaatgtgcattattcccgctcacaactgcttgaggcactgacgcagacgcaagattccctggtttattatcgtctgctcgccctttacgggaaaacattttttgtctcttccgattttgattctatactctattacaaccgccgggtaaaagaattttcccgcaatgcttcccaatcttctgaatctctccagtctccacgatggaatgatgtattgtccgatgtctataatatcgaaggcaacgtatggatgcaactgaaccgccctgattctgcaattatcgactataagaaagcctatggatatcgcctggaaggaaaaaaactacacctgcttccggatatttgtatcaatatagctgatgcctacctgcatcgcagtgacttggcgcacactgcttcgtattaccggcgcgccctgtttctctgtgattctttgaacttgtccgagcacacgaaatttcctgtctactacggattggggcagacttatatggaactgcgcgatttcgatttatccaatcattactatgaattggccgggcagttcttcgatgaaatgaacgtgagcgagcaatggacctatctcaacaatcgcggcaaccattattattaccggaaaaactatcaggaggctttgaaatatatgcgcagagccaatgcactcgtatcttcttatccgcagatggtgtttgaacagaactttatcaaagtaaacctgggagaattgtacttgctgactgacaaactggactccgcacagatctgcctggacgaaagttatcgtttcttctccgatatacagcataactcggctgttcattacattgaaacccagatgattgaactggcattgaagaaaggtaatatagcccaagcgaagactatgatcgcccggactgctcctgtggggcatcttgacgccaatatgttgactatacgcaatcagtatctgcaacattattttgagcataccggtgattatcgccgtgcctatgaatacctgaaacgtgattgccatctggacgattccatccggagcgaacggatacagatgcgtgttgccgaattggatatgcgttaccggcaggatacgatagtgcttcgtaaggaaatgaagattcagcgacaggcggcagagatgagagtgctcaagttgagcgtatctatctgggtacttgtctgcgtgttgcttgtggcaggggtagttgtctggtatatgcgtaaaaagagggagtttcttcgccagcgtttcttccagcaaatcaaccgtgtccgcatggagaatttgagaagccggatttctcctcattttacttttaatgtactgggacgtgagatcaatcagtttaacggctcggaagaggtgaaacataatctgatggaactggtgaaatatctccgtcgtagcctcgaacttaccgagaaattgagcgtatctttgcaagacgaactggatttcgtccgtacatacatcgaactggaacgtggacgtgtcggagaaaattttgtcgcaacaatcacggtggaggacggtttagatgcaacccgcatcatgattccatctatgattgtgcaaattccggtggagaatgctattaaacatggactggcgggaaaggacggaaaaaaggagctaatggtatatgtttcccgtgaaacaaatgggattcgcataacggttaccgacaacggacgcgggtatctcccgcaggtagtttccgccacacggggtactggtacaggattgaaagtgttgtatcagaccattcaattactgaatacaaagaacaagagtgataaaatacgttttaatataaccaacagaagcgatggacaaaccggtacggaagtgtcggtatatatcccgtttcgtttttcttatgatttatgatggagacagaagaaaagtataaggtagtcatcgttgacgatgaacgtacagcgattgatgctttgcgccgagagttggagccctatcgtgaatttgaagtaaaaggaatcgcagggaatggtgcaaaaggtaaaaagatgattatggagttgcatccggacttattgtttcttgatgtggaacttccggatacgttgggactcaatctattaagtgaaatcagggaggatattttgtgggatatgaaggttgtgttttacacctcttatgacaaatacttgcttcaggcgttgcgtgagtcggctttcgacttcctgctgaagccttttgaagcagaagacctgaaagtaattatggaccgttaccggaaggctatgacctctacttcgcttcctcttttgccttcttttgcttcttctattagtgcattgatgccccagcaaggcatgtttatgattagtacagtgacaggcttcaaactcttgcgactggaagaaatcggcttttttgaatatctgaaagataaacgtcaatggcaggtggtcttgtttaatcaaacttgtctgaatttgaagcgaaatacaaaagcagaagatattatcagttattcacaagcttttgtacagattagccaatctgctattgtaaatgttaattatctggcaatgattgatggtaaatgctgtcaactttatccgccttttcacgataagaacgatttgattatttcccgaagttatctaaaagaactgcaagagcgtttctttgttttgtaatgtagacctcatattatgaaatacgccacttcttcagcagaagcggcgtatccttttgttagaatattagaatgagagagagtttatgttacatatttgtattatccatcgtaacggtcatttcgggtaccagtacgtaggcttgttttttagcgttccatttataataattcgtagtaacggtcttgccttcataagtgtaattgatgcgtaggtctttttcccatgcgtctttgctattgttccatttcaaggcctcgctttcaatcatacgtttgttgtcatcgtacttgtagttgtacttcatgtagttggcaagtgtatttccgtccattttgtaaacggtttgtcccactgtcatgccattctcttcgattggattataaatcaattgattatcgtagctacgtgcagaagtagcaagcgatacaacaagaagagctgcagataaaacgaacatttttaaagatacttttgctttcatggctatttaagtttttgggttatactttcatttgtctaccaaatacattggttttatgctgcaaatctacatattaatttggtatttatgtatttttgaagataaaagattgtcaaaatgtcaagagtggaggtgggtgctaactagctttttgccaatattggtgacaaaaaaatatccggcagtcaatctgccggatatagaatgaatcacttcgtcgaaaaaggaatcttttttctagctttctggatacagagttaaataatgttattacccagacttgcctccattttgtaagcggaggtccctgataaggtggagtctccttgtgtaattagtgtctaaaagatagcaattccttattgaggtggcctttattcacttgatggtttaatgtgcctcaagccagtttttgccccatccgcaatctgctttcaaggggacgtgcatgcggtatgctttctccatttcttcgatgacgatttcttctacacgctctttttcattgacaggaacgctgaaatttaattcgtcatgtacttgcaggatcattttggcttgtattccttcggtctggaaccgttgatagatacgtgccattgctacttttataatatctgccgcacttccctggataggggcgttgatggcatttcgttccgcatatccgcgtacaacggcattccgcgaattgatgtccggtaagaagcgcttccgatggaagattgtttccacatagcctttttcctgggccacctgaatgcttttatccatatatgctttcactcccggataagtttcaaagtaaccgtcgattaactctttggcttctttacgatctacattcattcgttcggcaagaccaaatacggatatgccatagatgataccgaaattggcagtcttggctttacggcgcatgtcggaacctacgtctttcaggtcgatcttataaactttggcagcagtggccgcatgaatatcgtgattgctaaggaaagcatcaatcatattcttatcctcgctaaggtgtgccatgatgcgcaattcaatttgcgaatagtcggcagagaagaagaggcagccttcatcggggatgaaagccttgcggatttcttttccattctcgtcgcggatagggatattttgtaagttcggattgcttgaactaaggcgtcccgtagcggttacagtctggttgaaagaggtgtgcacccttcctgtacgtggattgataagctgagggagtgcgtcgatatacgtgcccaatagctttttcagtccgcgatgttccagaatcttttctactaccggatgtttgtgccggaggctttcgagcacttcttctgaggtgacgtactggccggtcttagtcttttttgccttctctacgattttcagtttgtcaaacagtacctcaccgacttgtttgggcgaagcgatattgaaagtctcaccggccaattcgtaaatctctttttcgatttgctccatctgggcggtgaaatgggcggacgactgcttcaatgcttccgtatccagcaataccccgttccgttctatattaaccaatacgggaactagcggcatttctatatcatagaacaaacgttctgcgtcattttctttcagttctttctccaatacatttttcagtttcagagttacgtctgcatcttcgcaggcatatagatatacatctttcgggtcgagatcgcgcatgttcttctgattctttcctttgggacctatcagttcgtcaatgtggatagtctgatagtgcaggtaaatttccgcaagataatccatgccatgacgaagttccggttgaagaacataatgagcgatcatcgtatcgaaaagtggaccttttactgttgcgccataattttgaagaacaatcatgtcgtacttgatattttgtccgacttttaacgaattctcattttcgaagaccggacggaactcatttacgatttttaacgctttgtcttggtccgatggtacgggaacataaaaagcttcattctctgcaatcgaaaagctcattccgactaattcggcatccattggttcggttccggtggtttccgtatctaacgagagaattttcgatgtaagtaacttttgaataattttccgccttttctcttctgtatcaatgagttgatagttgtaagtgagcgattctaacgtctctaggttcgatttttttgcttcacccggttcatcgggcgtgaaattcgcaaataaatcgccttgcattccgcctccttcttcgggaaaaagtggaagaggagagggggcactttttccagtagcaactttgcttccggtggcagaggttattccgtttccggaaatatcttttttgagcacccggtcgatgagtgttctaaattccaattcctcgaaaatgctgcggagtgaattctcgtctgcttcttcgcggacaagagcatccatctcaagttggatagggacatcgattttaatggtggcgagaaatttcgagaacgtaatcatttcccgattggtttccacttttgttttcaatgctcctttcagttggtcggtatgttccaataggttctcgatgcttccgaattcggagaccagtttttgagcagtcttttctcctactcccggacatccgggaatgttatctgaagagtcgcccatcagtccgagcatatcgatcacctgtgttggagactgaatgtcaaacttggctttcacttcctccactcccatcacttcgaaacctcctgtgtgtttggggcgatacataaatactttgtcacttaccagctgcccgtaatctttgtcgggagtcatcatataggtagtgataccctggcgaccggcttcggtagcgagcgtacctatcacatcatcggcttcgtagcctgccacttccagaatggggatgcggtaggcgcgtataatatcctttataataggtacggaaagacgaattgcttctggagtttcttcgcgttgtgctttatattgttcaaaagcctcgtggcggaaggtgggacctgcggggtcgaaggctactcctatatgagtgggattctcttttttcaatacttcttcgagggtgttcacaaaacccagtatggctgaagtgttgaatcctttggaattgattcttgggttcttaataaaggcgtaatacgcccgatatatcaatgcataagcgtctaaaagaaataatttattacctgaatccatagatttaattaatttttcatggtaaaagtacaaaaaaatacggtattaagcgttttattattacttttgtgctcaaattgtgtaataaatggacagtatctcacttatcagaactccgattgaagcggaactgggcgacttcaaagaactttttgatagttctctctccagttcaaatgcattgctcgatagcgtcgtatctcacatacggcagaggaatggtaagatgatgcggcctattcttgttttactcgtggcacgtctttatggagctatatgtccttccactcttcatgcggctgtttcactggaactccttcatacggccagcctggtacatgatgacgtagtggatgaaagttccgaacgtcgtggacagctctcggtaaatgctatctttaataataaagtagcggtgctgacgggtgactatttattggcaaccagcctcgtacacgccgaactgacaaacagtcatcgtattattcagctggtgtccactcttggacaggatcttgctgacggtgagttgcttcagctttcaaatgtaagtaatcacagtttttccgaggaagtctattttgatgtaatccgcaagaaaactgctgctctttttgctgcctgcacaaaggctgccgctttctcggtaggtgtgggtgagggggaagctgaacttgcccgtttgctgggcgaatatattgggatctgtttccagataaaggatgatattttcgattactttgataataaggagattggtaaacctacgggtaatgatatgcttgaaggtaaactgacattacctgctttgtatgtgctgaatacgacgaaaaacgaggaagcgcaagaaattgcaatcaaagtaaaggagggtacggctactcttgatgaaatagctcatttgatttcgtttattaaagaaaacggaggtattgaatatgcggttcagactatgaatgtctataagcaaaaagcttttaatctattggcttctttgccggattctgatatctgtgcagctctccgggcttatctggattacgtagtagaccgcgaaaaatagttacttccggtattttgccagaagtgaatagcacaataataaccggtcccaatcttctatcttttccgatttcatcgcttttcctaaaaggaaactcttgtctatttcttccgctgtatgaagatctaaagagcataatttggcggcttgctctatgtagtcccaggctttctctttggtgatgtgaccacatgcttgggaggcgcgcgccaggctcacaagcagtcccatatcccatccgataatgcctttttccaagtcatttatccatataatagggtcccttctttcctctgtatatttcacaaatttgtatagattctttccttgacggataaagcgttccactccgaaaaaacgcttttgaatgatgttttcgaactcgttgatgttctctgtagagagtaaataggggagcataatctggtaggagactctgtcgccttcgttgataaggaactggaatagtccggtggcggactcattatcggtgcagtgaaactcctctgttaacagtttggatagcttttgcggatggattccggtctctatggagttgagatagaagccttgcagtccggcttccatataaccgatgcgtagccccttctttttctctgctccgaggatgaggttcagagggttgtgattgaatcttaaggttcttgtatatgcgtccatcctaatacctccaaaggttcatgaaaagcgtgagaactgttgccatgtattttcctgaggcttcggcaagccgttatgagtatacaagcaacagtcccacgctccattcgatatataacaaaagtatatacatgaaggtgcgtgagacccgtttgcttattaccattcataactttgaattttgccgaattccaggaattggtaataaatgaaacgttctctaatataactaattagctatattttcatcgctaaaccttttacaaagataagtatttttctgaattctcctgtaactatctttagattttcttaaataaaaaataccgcgtcggttcccggagtacgggaatcgcgcggtaaggcgtatttgattgctaatgtagcctttagcttagaagaacttgatttcttcccctttgatgtcagaaagaaggaggttggctaagcggctggttcccaggcggaacagttgattatccagccattcttcacccaatagctcttttacaattgtgtagtaaataatcgcatcattaacggtattgatgccacctgccggtttgaatccaatcttgattccggtcttctggtggtattctttgatggcttcacacatcacgtaagcggcttccggagtagcggcaggctgttgcttaccagtggaagtcttgatgaaatctgcgcccgaatacatggataggatagaggctttcttgatgttggaagcgctctttagtgcaccagtttcgaggatcactttgaggtggcgttccttgcaaacttcctttaattcctgtatttcttcacacattccttcgtagtctccgcttaggaatttgccgatggaaatgacaatatctatttcatctgcaccttctgcgattgctaatgctgtttctgccacttttacttcaatgaatgtctgtgaagagggaaaacctcctgatacacaggctatattgactccgtctacctccagcgtattcttaacgatggctgcaaaattggggtatacacagattgctgcaacatttttaagatcaggatattcgtcgtcaaactgattgactttttcggtaaagtgcatcacacttttgtcactgtctgtactattcaaagtagttagatcaatacagttgaacaggaacttcttaacgtcttccgtgttgttttccggcacttttttctcaatcaattcagctacgcgagcttgaatatctgcatcgctcagattggtattatactttgccaatgcggcattgtacttgttgggctgtgagttattctcttccatgatctttcagttttgggttgttgatatgtcttttattatctcgtttcgttttcttatccatgcttttctggaaagcagtggttatgtctacacctgtctggttggcaatgcagagaagcacccataaaacgtctgctatctcttcatctatattatctttctctccctctttaaaggattgatctccatatttgcgggccatgacacgcgccagttctcctacctcttccgtgagaactgccatattggtcaactcgctgaagtagcggacaccgtatgttttcacccattggtccacttgtttctgtgcttcttccagagtcataattgttgatggttagttattattctttgttttttgtatccatgcatatagtaacgggaccgtcgtttaaaagttcaactttcatgtccgctccaaagatgcctgtacctatttcttttcccaatgcaccgcttaaatctttgcagaattgttcgtagagtgggatagagacatccggcttggcagctttgatataggaggggcgatttcctttcttggtagaagcgtgtaacgtgaactggctgataaccagaatctcacctccatcttctaagatagatttgttcattacaccattctcatcatcaaagatacgtagatttacaatcttcttgcagagccagtcgatatcttcctgcccgtctgcttcttcaataccgactaatatcagcatccctttcctaatggacgacttacagtgtccttcaatggttactgacgcatggcttacccgttgtatgactattctcattattatttattctatttcatgattaggaaaggcaaatttacaaaattcagaagagaaaacggtgtgttggtgggaaaatattgtgaattcgctccgtagtcaataggaccattcgttattgtttgttgtcaattcgctatcttgatagtgataatcaacttattgattgttatggtttgaaatttagagcggcactgctcgaactttcgaacagtgccgccttggctgacgtatttccttattgttgttcgttacctaaaccttcttttacagtcttggctttcgcttctccaatcacagcggaaatctcctcaaaagaggcttctttgatccgttttacgctcttaaattctttcagaagcgctgtttttgtcttttctccaatccctttgatattgtctaatgccgatgctacctgccgtttgctgcgtttatcacgatggaaactgatggcaaagcggtgcacctcatcctgaatctgtgtcagcaaacggaataacgggctttgctgtttgataccgatagtctgtggaggaaatccaaaaagcagttccgatgtgcgatggcgattgtcctttgccagtccggcaatcgggattgttaagttcagctcatcttcaatcacctctctaacgacctccatttggccttttccaccatcggtgataatcaggtcgggcagaggggtgttctcttcaatagcgcgctgataacgtcttctgacgacctctttcatggatgcatagtcgtcaggtcctacaaccgtctttatattgtatttccgataatccttctttgagggtttagcctttttaaagacaacgcaagcggccacggcatcagaaccctgtatgtttgagttgtcaaagcattcaatttgcaaaggcggtctgtccagatgcaactcttgctgtatctctttcattaatcgcatacttctttgctccggattcagcttttccgcctgttttagacggtcggctttgtattgcttcacgtttagaatcgaaagatccagcaatttctttttatctccccgctgtggaacggtaaatacgatgttgtttagctccaaatcaagttcaaaaggcactataatctctctggattgactcttatagcgttcccgcatttcgataatacccagtgtcaaaagttcttcttttgattcattcagcttctttttatattcgaatgtaaacgcctggttaatggcgccgtttgtaatatgcagatagttgatgaaagcggaattggactcgtcctcttcaatagaaaatacatctatgttgtgcaatacagcgcttactacctccgatttggaacggtagttttctatcagaagatatttctctttcaccttctgtgcttcttcaaacttcatctcaccggctaatgtctgcatcctttccagtagcatacggctgatttcttgtgtatttcctttcaggatctctttgatttcatcaatgtttttgagataatcctcctgtgattgtagcccgatgcatggtcctgcgcagttctttatatgatattccaggcatacgttaaacttaccagcccgtatattctccggagttaggtttaaactgcaagttcgcaaaggatataaatgctttatcagatccagtaccgcatacatggatggtatgtgactatacggtccataatacgaagaaccgttcctgataatcttccttgttctgaaaactctgggaaaatactcgttttgtacgcaaatagaagggtatgtcttgtcatcctttaatagaacgttgtagcgcggcttatatttctttatcagattattctccagcaataacgcatcttcttccgtgttgactacaatataacgaatatcggcgattttgctgaccagcactcgtgtctttcccggttcatgctctttgctgaagtaggagtagactcttttctttagatttttagcctttccaacgtatataattgtgccctccgtgttcaagtattggtaaatacccggtttctcgggaaggttggctacaatccctttcaaatattcattggctctgctttctggttctgtattcataattgttaggtacgaaagatcgctagctgcttacttttgacacattctctgcaaatagaggcaagtcctttataaagacaataccgattctacttctacgtcatctccgaacaaagattttccattcagttctttcaattcgatgatgaagtttacatatacctttttaggctttagtcttttcaccaattcgcaagctgctttcatggtgcctcctgttgccagcaaatcatcatgtagtagaattacgtcgttttcgtccagtgcatctttgtgaatttgcaccgtgtctttgccatactccttatcgtagctttcttcaatcgtttctgcagggagcttgccgggcttgcggataggaatgaaaccggcgttcagacgggttgccagaatcggtcccataataaagcctcttgattctatacccaccactttggtgattcctttatccttatacatatcgaacatgatattggataattcctgcaagcaccatggatctttgaatagagtagtgacgtcgtagaacaggattccgggaatcggaaaatcgggtacttcccgaatgcttttgattagtgtttctttgctcataatcattgaattatatcgtttctttaaatgctttgtttcacgtgaaacgttgccgcttatcgtcccgaaagcaccagcagcacgttgatgtcgctaggagagactcccgggattctgctcgcttgcgcgattgtttccggatctatctttaccaacttttgccgagcttcggtggaaagggactgaatggtagaatagtcaaattttcctttaatcttgatactctccaatcgtgctagtttttcagctatcattctctctctatcaatatatccttgatacttgattaggatttcggcagcttcgagaatctcttctttccggtcttgatccgaactcgtcgctttttccagttcgcgttgaaacgccggaacatattctgctatattttctattgtcacttgcgggcggttcagaatctctatcaacttacaaccttgacgtaggggcgttgtccctatcctttcgagagcatcgttgattagtgccggtttcatcgaatagttgcgcgcgaaagaaatgatttgttccacggcttctttcttgcctcttactaactgatatcgatcttcttttgccaacccaagcttaaatgctttctctgttaagcgcatatcggcatcatccatgcgaagcagaatgcggtattccgcacgcgaggtaaacatacggtaaggttcatccacacctttggtaaccaaatcgtcgattaatacgccaatatatgcttcatcgcgagccaaagtaaatgcttctccgccgtggcagttaatgtgtgcattgataccggctatcaatccttgtcctcctgcttcctcgtatccggtggttccgtttacttgtccggcaaagaacaaatttttgataatcttcgattccaacgtatgttttaattgagtcggatcgaaatagtcatattcgatagcgtatcccgggcggtagataaccagatctttgaaagccgggatttgttttaatgctgcaatttgtatttccatcggaagcgaagaagagaatccgttaagatataactcttgtgtcgtttctccttccggttcgagaaataactggtgctgatctttatccgggaaagtgacaatcttggtttcgatgctcggacaatagcgtggcccgatactttgaatctgtccgttgaacaggggagaatccggcaaaccttcacgcagaatccggtgtacttcttcattagtgtagcatgtccagcattgaagttgctttaagtggcgcgtgctagtattcatgaatgagaacttgtggaagtccgattcgccgtcttgtgtttccatctggtcaaaatgaacactacgtgcgtcaattcgtaccggagtaccggttttcattcttccgtaggtgataccgtggcgggcgatggattcggtcaactgataggaagccggttcggccattcttcctcccggtaatttatgacgtcctacatgcatcagtccgttgaggaaagttcctgcggtgagcacaatgcatttcgctttgaaggtgacgccccatgcggtgaccaatccagtgacctcaccgttttctacgagcagttcacatacggtatcttgccagatatgaaggttgggtgtattttccagtttctctcgccaggaccaaatgaacttagcccggtcgcattgggcgcgggggctccacatggctggacctttcgagcggtttagaatccggaattgaatggcagtctcatctgtcactaatcccatctgtccacccaatgcatctatttcacgtacaatttgtcctttggcgattcctcctacagccggattgcaactcatctgtccaatcttgttcatgtccatagtgatgagacaagttttggaacctaaattagcagcggctgccgctgcttcacaaccagcatgtccggcaccaattacaattacgtcgtacttaaaatccattcctatcttatttattatcaaacgctgcaaagttacagaaaagttgtgagacttgtatcttcaagctgtttttgcttctgaaaatccgaggaggaatccggcttaactgaaaaaaacgtcgtaatttcgggttagaaatatgcagattgttcgaaaatagaccgcttattggcttttgtgattgtatattttgggatggaatggcaatagtttgtcttttcaatcccttgttttgctttctttttgttagttgtgtgcttgctcaattatgagtgcaactagagagtaaaaggaaagatttgttgaaaatgcggattgttgtgaaaataaacgtgaggtttacactcaaaatctaccctacgtcttgacataagtcaaaaaaataagtctgaatgtaattttttgtatgatggcttttgctgttttcgcaaacagctatacctttgcagtgtagttgtgaaactacttatattttaggtattagaaaaaggtaataattaaaaggtattagtttataaaactaaggtattagattttaagattagtttttaggaaaaagattgttttgattaggtattaggaaaaagacgttttcaggtaaagagtaaatgaaagatgaagaaaaagaagaatcccatttatggggattctttaaaggtggggcggaatgattcgctctttttttgtgccctttgttcattctcttcacattgagataagtctcaatttatcagtctttttacgtgattcgttgagtgaaaatacctctttcacatccttcacagtcgtaagcgtctccgcgattctatatagtgtattaaaataaaaaggctaatgatcccaaagcaaagcttttctcttgattttttagaaagaggaacatttactgaatatccctaagtacttccgccggattttgctgggcggctttccatacacgccagatgatgcttaggaaaatgacaaatcccattcctatgaatatgactgcatagagccaccattctatcggtgtttgctttatataattttctagccaatgtttcatcatgacatatcccaacggaaaagcaaagaacgatgaaaacacaagtaaaagtaaatattctctaaagaatagattcaggattattcctatattggctccatttaccttgcgtatagctatttctttacgccgttgctggcaggataaagtcaccaatgaaaatatgccgaatacggcaatcgctatacatataaaagaaactatgctcaacaattgacacaaagttctctctgatttcatataagtgtcataaacctcttccatattagacaacatcaattctgcatttggattaactttattcacttccgcttttatcttttcagaaacaacgttccaagtcccttctttcactttgaatataatacctcctctgcctgtattatccggcaaaaaaaacatagcaggggctaccgggtgtattggggcattatatgaaatatttttaataacccctttcactatataatgccttcctaatttatcaattttctttccaaccggttgtgtccatccgaaagctttcacagcagcttcatttataacaaccatattttttccatccttttcatccagcatgcttccctccagcacctcaactccaaagaaatcggcatattcttgattgatcgtctcatcttctagatctatatattgctcactatcagttgtctttccttcccactcctttatcctgaatgttgaaaaatacattttgggaataggtgtctgaaagccactcaaatactttgtaacatcgggcatctgttctaatatttctttaaaaggaacattttcagagcaataaacaacagctcccacattatgccgttctattccaagttctttggtattcaacaagaagttaagttgcttcatcatcaccaaagtacaaaaaacaaaggctataccaataaacaactgaaataaaatgctactcttataaaaccaaccggagagatgaagattagattttttgtttatattactaagtagagttcgcttgctaatgtatcgtataagcagagatgcaaaaccaactgtcacggcaatcaatgatagtatataaacaaatacttcgatataaaaaaatgaagcaccctcatagatttgtgacaaacgtttaaaagtcggcaggatgagttctatcaataccaaccctattcctgaagataaaattagtaacaagacaagttctgtaagaagtaaagtgagtaacccaccatttgatgaaccattgactttcctcaacgctaactcacgtttacgcatccggatacgagttatcaacattgttaaataattacatattccacaaattataaccaaaccgctaatacatgcaaaaagacgaatatgattcaacttcacattcacatcttccctcggatgactactccgcaatgtggataatggagcaataagcgtagaatttggatatttatgaccatcttgttgtacttcatattctgacaacctctgtttcaatgcttctatatcacagttgggataaatacgaaaaagcgtttggcatcgttggttcccccaattggggtttgtatcatgaaatggcaataatatatcaaatgaaaacaaagagtgtccttcccatgactttacaactgcaacgattattttttcttcgttactttcctctaaaatcaagtgtttacctatcggagattctttcccaaatattcgctttgccgtattttctgttatagcaatttcatccttttttagctgtagatggttatctccatccaatactttaatattaaacattgaaatgaaatttgaatctacctctatacgtcgtaccacaaactcaacatcctcattcttaatctttttttcattccagtcataaaatatacgacatactttctctatctccggacaattctttgccaaataatcagctagaaaactagatgaattataggtaaatccgtctccataaagacgaaagctactgcctgccagataaatgcgatcggctccctcatgaaaattatcatacgtcatttcataacgtatccataataccgacagcgcaaaacaggtaaagccgactgctaatccgataatactaacaagactttgtgttttatactttatcagattacgaaaggctactttcagataatgttttatcatgatatactttttattgatagcttgtgcttacatactaacttcggtcaccacctgtccatcaaacaggtttatgatacggtcggcataaccggcatcgtgttgtgagtgggtcaccatgacaatggtggttccctctttattcagttcgctcaatagccccatcacttctttaccgtttttggagtccaggttaccggttggctcatcggccaaaatcagtttagggttggccacgacggcacgggcaatggcaacacgttgctgctgaccaccggaaagttgttgcggaaagtgtttactacgatgagtaatggccattctctccatagctgactctaccctctttttccgttcggcagcggaaatacccatataaagcaaaggaagttcgatattttcgtatacgttcaactcgtctatcaggttaaagctctgaaatacgaagcctatcacgcctttgcgaagactggtacgttgcgactcggtataccgggagacttccgttccgttcagataatactctcctcctgtcgggttatcaagtagccccaaaatgttgagcaatgttgacttgccacagccggagggacccatgatggctacaaattcaccttgtttcacttcgatactgacgttattcaacgcccaagtttctacttcttccgttttgaaaatcttctgtaagtcaatggtcttaatcataactgtattgtttttagaattattaattttattcgtttttgattacttctgcgggattgagacgtgcaatccgcagtattttaaagataatggtaattactgtcaataaggttactccccaaaatatgcttccccaatataatattccatcattaaaaaatacggtgtacatttgtttccacagttgcaataccacgtaaatgagcggaaaggtgatggcggcagtcaccatcagcaaaatcaggtacaaacgtgcaaacagccagatgatggaacgtattccggctccgttcactttgcgaatggcaacctctttctggcggcgttctgtatcgagcgtaatgctggaatacactcccaacagggtaatgatgatgcttacaattgcaaaaaacgagatgatatctttcagaatatattccactgcctgcacttcgtacaaatcatcctgaaatgtacgtacttgggaagaaatattctccggcagcacttcacgacggatggtttccatccatttcatgacttctttttgctgttcagggtaacatttcacatagcagtgacctatgtattcagaagaatcataaagtgtgaaagcatatccgccattatggttatgtacatctgtttgaaagggggcacatactccacaaacggtgaaatcactggtctggtcgtaaaagttcattccgatgatatctttcttttgtcttttctgccagacttcatccattacgagatccttttttgtccggatcgtcctgccctccgttatcggaatattcataaaggtgaagaaattcaatggtacacacattacattaatatcaatccaagagttatcatttcctttctccgtcattaacaagtttccggatattccatgagtataagatatatcagataacaaaatatctttcacaccggcatgctgcctgaaacgttccaccatttcctgtttttctttattctccagaaatggatagtccagcggaatactaagaatcgcttctttatcttcctgacttaacgtatgaaataaggtttcagtcacctttcctgattgcaaaaacaggctgacagtcagcgttacgaatatccagcaaataaagaactggacgccgagcataaagttacgtccccactgtttcccgcgacgtttttgacctccatagatacctgtctgtatggaagacctgcgaatacggacggataccagcagacagactgccatgcaaagcaatgcaagaaaaacaatgtattgcagaatatgctttaatagtgtttcaggagggaaagtcattgtgaggcctggcaaagagaaatccattctatctccaattagttcgataccccatatcaccaaaaatgaggatgcaaatacaatcatcagtgactgtgttaataacaggcagaacagccgtttccaatcagaaccaagcattttcattatggcgtattccttagtgcgattcaggaaagagccgatgagaaaatgaaagaaattaatcaatccaaccaacaatatcaatatgccgacaattccggtgacccatcccagaatataaatacctttctcctgcgaccggtctcctatataacgggcaacaacggtataagtctcgttatataggctataagtatagtcgcgcttggaaaattgtttttccaaaccagtaatgccaacctgcggagataacaaaacgtatgtccgggctcccgttatatcgcgacgtttcggactctgaaaaagtccctcactgtcgttgataaccaatgcatcggtatgacacataaaattaaaatcattgttcagtggaagatcttccatcactgcttggattgtgtacacaatacctcctgtctttggtgtactgtccggagaagtataaagccgtcttgtaagagtcaggtgtttgccaatggcagtctccacctgaccaaatatctttatggcagtggaccggcttataataaccgcgttgggcatccggcttgctgtccgccagttaccaactaccatttgcggagtaaagactttattgtatagggtatcgacttctataatttcaagatcgtatggcaatgatttatccggagacagttcaacctgaaaagagcgttcacggggatatgccatacaagagatcgcttccacttcacccatagcccaagtacggagttcttcggataatgctacttgtgtgccggaaaaatagtcaccagtctgttcattatagagatttaactcggctatgcgggaataattgtcaaagcaatgattggtagattctacaaaacgactgcaatacatacatatactaaaacacagtagtcctactgccaatccgatggtggaaattatattctgtgccttgtacttccacaagtttctaaatgctactttgaaatagtgttttatcataatatcttagattcattcagtttttataattttagcaggatcaatatgcgcaatcttgtttatttgccagaatagagtccctaaagaaataccaccaaccaataacaaagctatcaaaaagattcctatacctataggagctttcactacaaaatcctttgtgtattcatatatcagataccaggataatggaagagctactgcaaaagccccacctaatatgacaagatacttgcgtcctagtaaaagatataaatctttcagtgatgctccattcactttgcgaattgcaacctcatgggaacgctgcctaatgtcaaataatgaaataccaaacaagccaagacaaactattacaatagctatacaagcgaaaagagcataaacagaagctatctggcgatcatttttataaagttcagccacatcgtccttcaacaaagaatatttaaaatcctctgtaccatacactttcttttgaatgcttttcaaatagtcaataactgcctgttctttgccggagtggcaatatatctgatataaatcaccgtctaattgactaccaaccataaagaccatcggatggacacctgtactaatatgtccgtcataataatcgtctattacagcaacaataggttgagccggaaaatccgggacgtttcttttcatcatttcatcaaccagcatagctccctcacattgcgtatatcctaaggctttcaatgccgcacgatttacaacggccactctatttcttgagtcttcatccatttccggcagacttccatccacaaacgcaagattgaaaactttaaagaaatcaggagtaacataagattgcaacaacgcaactgtttctccttttacactttgaaagtttgtagaataatagtctcccaaaatagatgaatgtcccgtcgtccaatactgaatatccggacaactcttcatgagttggtctatttcagtaatcctctcttgccgttgtttgatagtctccatagtgtaaactgcgaaatctcgtgattcatatatcaagtttgcttgaattacagactctacacgaaaaccaggatcggtatgtaacataaaattcagttgcttgctgaaatagattgataataccactaacaggaaagtaatcatatattgcagaaaaagaaagatcatacgtgaacgaaccgaatggttatctgtacctaccttccggattgaaacagccaacaaagaacgttggcactgcacaaacgcataaatagatactaacagaggcaaaaacaacaaaatagagaatgataatatcccatcaaatgcagtatacatcagctgactgccaaacatagatgatacaggaatatttgtcacctctacaatgagccaggctactatcatggaagcagcgatcaataaaaagttttctatgaatatttgcttaaacaacgcttttctatcagctccaaaaactttccgcaagctatacaccttacctcgtttcaccatcaataccagataaagattgatgaaattcatcacacctgcaagtaatatcaacaggcaaattcctcctaaaataaatagttgggaacggtttccgctaactagcatatctggtccggatcgaccaattaaagcccgatcccaatacatatcacttataggaactagagagaaagtgtatttccgactatccccgctacgagcatcctgattgataaaccggggataactcccggccttattggctttcattacttccgtttctgaagtgaaacggataaaatccaaaggcatacgctcccataatgatgatagttttgaagagaggaccaagtcaaaattaaacatccgcttattaattggttcctctaatatgcctgtcaccctaatctcctttccattcgaataagtgagaatcttgccaataggattttctttgccgaaaagttttttagcaaaaccctccattaacaaaactgacgccggatcttccaaggacactgaaccttgtaacacacggtaagggaaaagttcaaaataagcactatctgctgccatagcttgaacaggaatacgatttgactgataggtcaaataatcattttcgagcaacacgatgcgtgaacgcgtcactatgccactattatcaatgtaaacactatcccggctccctatttcagccacacttaatacccgatttccttcaaacgttgtctgtacaccatacacttgattacgatcaatgcaatgtgtgtctactgtaagctcacgatgaatataacgaagcaaaataatgcaacaagctaaactaaaggctaacccgagcaaattaataatagtatatgattttgtacgcaacaaaaagcgtatcgcatagtacaatgttttcatgttttatctatttgttatttttcattcatttcaagatcaattcttccgcatcgccaaaggtatcatatccggtggtaataacccaatctcccggctgtaaaccttctactatttcatattgttgcggattctgtcgaccaatattcaatggcacgcgaactgcttttgtctttgatgcatttactttataaatccattgtccgcctgtaaactgatagaagttgcctcgcggaataatgagcgcttgctccggctgtcccaattcaatctgtacccggaagctcttgccgactcttacattatcgggcatatctccggtaaaaataagatcaatatcaaacatacgatctttcacttcgggaaccacttttgttattttcagcggatatttgtttccttgatagttcacggtagccggtagtccggtggtgatccggtcgatataatattcgctaagtgaagtatggattttgtattgatcgagcacttttatttcagcaatgctttcaccggaggaaacctgctgccccggagtgacctttacgaaactaagctgacctttcagtggagctgtgaccaccaagctattcagtcgttcgcgagtacgttcgtactttttccgttcccgctcccggtcgttacgaatcaattccttacgtatcatcgtgacagcagaatcatgtcgcaagctctcttgttgcagggctgcgtttttctgtttgtaacaatattcatcttcagctacctgcaactgcgccttactcttcactcccatctgaaattcttcgcggtcgagagcgatgctttttttcaggcgttccaattcgtagctatttgtcagggcttgctgtttcaagttcagacttttttgttccatttcaatctcctgctcctgataggtaatcatttgcttttcccattcgtcacgctggtcttcaatattgcggagcaaatcgggattggaaagaataagaatggtgtctccctgctgaagcaaacttccctcttcaccgacaatcctttccacgcttccagtttcacgagtattgatcttgatggtcagtataggctgaatgagcccttccacatctacatattccatgaaatcagactctttcacttctgcaatctgtatattttcggcatctatccgtagttttctgggacctaaagacaaagtaatcacataaatcaaaaaggcggcaaataaaagccctcctatcagatagtatctgtaacgaatgtaccacggtttcttttctaattttatatccatgagattatctggtgttttacaagtttctattaattagggttccatcactattctttactgacttttcgttgttctctattcaatcagaagatggtagtcttctgtcagtatcgtatttcgctcaaaatcatatagtgtcatgctacggagtgtataatataaactccaataattatataaagccgaaatatagttacggcgggcactatctttctctgaaatggaagcattcaagtcaagaatggtagatttacctaatagatagagtttgcgggccacttcacttcttcgttgggctgtctcatccgtgcgggcagcgatccggacacgttgcgtttgcagattgaattgtttgacgagtttacgaacgttcagttcaaagtccgtccggctctgttcgacttgtgtgtaaaccagatcacgattggaacgggctactcgcacctgtccttttccacgtccccagtctaggataggaagagaaatgccgatacttacgtattgctggtccaacaaatttcgataagcgtcgggcagtttgtcagcagtctgcgtcaatccgaaacggagatagatatctgctttcaggccggcattggcgcgggctttcgccacagcactctcactttccagtttccgcctttccatcgtctgtatatccggactgttttcgtaagccagtgccagtgcttcattcaggttcacactgaaatccggaatttgaggactgacaaggacacgtaattcccgatcttcgtgaataccaagataggaacggagttcctgcatacaattatccatttcaataagggcattcatgcggtttgtctcttccgtcaaacggttaagttccagttgcagcatttcattttctgtgatggtacctatgttatagcggccttgcgcataacggtaaagtgtatcggcattggcgtaattaaaggaagcaatatcgtaatcgctctgggcggtggccaaggcaaagaatttattaatcgcattggctgatacgagttcaagcgtctctacgtagcttttctttgcctcctgatagcgcacgggctctatccgtctatcccatttcaaactattgtagccaaaaagagactggcgataaccgatcattatgggggaagtctgccatgagtatttatgttcgctgaacagatccatgcgttgagcggaggtttcgagaaagaaagagccaccggtccaggataagttctgtgaaagattcagggttaaatctgtattcaatagattttgttcgacaaactttaccgaaccgtctcccatcgttatcttgttaatggcacggttcagattcggatcggatgtcaggcttaaagacggcagataattggcacgataatatttatagttccaatacgcagaacggaaactgtggcgtgccgtctgtgcatcgggagattccatacgggcaatctctatgacttgcttcaatgacagctctgtggtttgatcttgagcagtcaatagttctgtcaacaatagtccgagagatatgaagattaatttcagattcattcgttggttatatttgttatttatcattcaaaagatgtgccattcagataaacagttatcattcaataatatagtaatattcctttcattcattcagtgtgcatatacgcacaaaattagtgcgcaatcgcacacacaacacatgagatttatccatatctttgctcccggagtttaaatggatagaagatatggaagaagtcaacaaattaggaaagatactcatagtagatgataacgaggacgtgctctttgccctcaacctcctactggaaccgtatacggagaaaataaaggtggctactacccccgatcggatcgagcatttcatgaccacctttcatcccgatcttatcttattggacatgaatttcagccgggatgccatcagcggacaagagggatttgaaagtctgaagcagatattgcagcttgacccacaagctattgttatttttatgactgcctatgcggatacggacaaggccgtccgggccatcaaagccggtgctaccgattttattcccaagccttgggaaaaggataaattgctggctacgcttacttcgggtatgcgactgcgtcagtcacagcaggaagtcaacatgctgaaagagcaagtagaaattcttagcgggcaaaatgcttcggaaaatgatattattggagagtcaccggccatgcaggaagtgtttgccacgataaataaactaagtaatacggatgccaatatactgattctcggagaaaacggtacgggaaaggatgtgattgcccgactattatatcgttgttctccacgatacggcaaaccttttgtcacgattgacctgggaagtatacccgaacaattgtttgagagtgaactgttcggtttcgaaaaaggcgctttcaccgatgccaagaaatcaaaagcgggacgaatggaagtggcgaccaacgggactttgtttttggatgaaattggcaatctttcacttcctatgcagtctaaattactgactgctatcgaaaaaaggcaaatcagtcgtttgggaagtacgcaaaccattcccatcgacgtccgtttaatatgtgccaccaatgctgatatccgtcagatggtggaagacgggaatttccgtcaggacttattatatcgtatcaacacgattgaaatacatatacctccactccgtgaacgcggcaatgacatcatcctgcttgccgaacactttctgaaccattatgcccgcaaatataaaaaagaaatgcacggactgacacgggaagccaaaaacaaactgctgaaatatgcatggcctggaaatgtgagagaacttcaacatacgatagaacgtgctgtaatcttgggagacggctccatgctaaaacctgaaaacttcctttttcatgcgacacctaaacagaaaaaggacgaagaaatggtactgaatctcgaacaactggaacggcaggccattgagaaagcgctccggatcagcgacggaaacatctcccgtgctgccgaatatttagggattacccgttttgcattgtatcgcaaacttgaaaaattaggcttatgaaacgatttgagttcaaagtagcattgcacatcttaattatttttctgctttctatcggcagttgtctgctgtatcaaagacagttatggttcagcactaccgtctgtattctctttttgataggtgccggtatgcatctctaccgaatacagttcaagcaaatcaccttgttacgacgattgacggatggacttcgctacaacgatatgacgcagaatcttcatccgcctttcaaaaataagatgatggatgagtgggcacaggagctttctaatgcattgaaggactttcggggaaagttattggcagaggaagtcaagcatcagtattacgagagtttattaaataaagtagatactgtcgtactcgtaaccgatgcttccgggcacattgaatggatgaatcaggctgcagtggcccatctggggcaaatatcacaactaccggacgtacttcaggaggcttctatcagcaatgatatgtccatgatccgcatcgagcagaatggtatcgttctggaaatggctatttcctgcaccacatttgctacacaggggaagaaacagcggttaatcagtctgaagaatattcattctgtactggaacgtaatgaaatggaggcctggcaaaagctgattcgtgtattaacacacgaaatcatgaactccatcactcctattatttctctttcggaaacgttaagtgaaaggggaatccccgaatcactcggagaaaaggagtattctgctatgttgcaagctatgcagactattcacagaagaagtaagggattactaggatttgtggagaattaccggcgactgacacgaattccgatacctgtccgtactaaagtatctgttgcagaattgtttatggacttaaagaaattattcccggaagagtatattcatttcgaaatgcctgcatctgatttatttttatatgtagaccgggcacagatagagcaagtgcttatcaacttgttaaaaaacgcccgcgaaacatgcgagcgaaaaatagataaagagatacagataaagtttttctctaaagacaacccgacattaacaatatctgataatggcgagggaattctaacagatgttttggacaagattttcgttcctttcttcaccaccaaaacatccggttcgggcatcggattgagcctgtgcaaacagatcatgactttgcatgacggaagtattaacgtaaaatcagaaatagggaaaggaagctgttttattcttactttccctaaatgagaaccaccgaaagcctcccgaatcctttaatacgatgattagtctgggtagtagaggaattacttatcctctactacccagactatttgtatcgggatttaactccttaaccgcctctttgaccgctttattagttggcttgcgatatgcttccgcttgttgaacggggacaatctcattcaccattctttcatatcctttttgctctaacaagtgcacttctttttcacctgtttctttttgttttcttgttttcataaggcttttcattttaaaattcttatttataaaacagcaaacatcgaaagatagttcatactcacagataatttatgtacggggcaaccacccccaatataccattatgagcttgttcactccggtacagttatgaacaatttaatattctttctctataataggcacaattcttccatccccttcactcttcctctgtatcaccgattaacagggagtttgcaggtgaagagccgttctttcaccttcttttcatcgtgaacaaaatcaaatagccgcttaccctgattacatcattgagcaagattagtcaagctatttcgttattagtttcaaccccatttgaaactaaaagtttcacgccttgaaacaaagtgtttctcctaatgaaacaaagtgtttcacaccgagaaacgaagtgtttcaaggattgaaactatttttgaaacctaatcgcttacaggtgaagaggtggtgaagttgttgcccttcacccgcaaactccctattcatcgaagagacagagaaaaggtgaaagaggagatgaaaagatgaattacgatgtccgatgatacttctaatctctgacaagaaaaaaaagtgcggtcgcaaagtgatgagattcaaggtattgagaaataataggtaaaaaacattcgtttagctattgttaattaaaaaatactccctatctttgcaccgcttttgaaaagaacaacccttcaaaaaagtagcggggtgtagcgcagtccggttagcgcacctgctttgggagcagggggtcgtgggttcgaatcccgctaccccgacgaagaaaatcaagtcaagattcacaaaataaagccagtacaattagtattggcttttttattatatataggataagtgtaattatccccgtttgggggcaaataaaaagggcaattctttgaactatctttgaacaggtttctagcattatcctcattttcttatttaatttagagtaaaaatctattttgttaactttactacccttttattttggcgttatcaatgttttgcgttaactttatagcggaaatacaaacattgtttatagagaaaacgataacaaacaaaatacttaaacacatgaagaaaactctgctgatgctcgttgttattttcatttcactatattcgcattcacaaagtccctttctgaattttagaattccagaagaatcaaataagcgtatcattggatattcttcaagtaataaaataaatgtttttttgaatataaaatatcaatcttgtaatactctaatacagtattacaaacaggattctaataaattgattgtgtaacaaaaataacgatatgatgaaaaagtttttttatttgagtgcgatactagccatagttttggtttcatgtaattcagaaaaggagtatatagcaaaactctctaataccgcttctatgattgagaaagaagctgatttaagtgaagcaataactcttcattattgtgatacttggagaaaagtaatttacgatcatgaatacaatggagaatattgcactgatttcaatgaagccttagcgaagcatcaggagtttattatcacaacagatacctataagagactaaaacaaaagagagattcaatcgaggctataatgccacaactaaatgattatccttccagttgtaaagatgcttataatgagttagtatcaatatatgcagatacagatgaattattcagattcgcagatgagcctaggggctctttatctacatactcaacaaaaacaacagacctttatcaaaagatagaaaagtcactgaaagaatttaaaataaagcatatacaaaacaaataatttaaaagagtagtatagttattgtagcagcttattgaatttaagactatcaaaagacaaaataataatttcacttcaagagcaacttcagaaagtactgctagaaaatagtgttcaaaagctagaaattactcttttgaattatgagttagaaaggaatagaacgaagatctcaaaatagcgtttttgaactagctttgaaatagtgacggtatatgacagcgataccgtcactatcgcaagcatataccgtcactatctttaccggatagcgtcacccttttacatgttcaaataataatcccgggttagcgtcatatattcctcactatattgatgacgagccagttctgtcaatagttcttctacaatgcactcttgattggaaaaagaaaaagtaatcaaaacacgtttcggaataccgccgggtttagtgattacattcagttgacggactgcatataatttctttatagaagctatcttttttacccgttcagctacatctgccggaatcaccactgtaaaaaatccgttttctgtcaataatccgcttactccttccaacaaatcttcatagctcaaagaattattgtgacgcgccgcggttctctgacgatccggacattccagcgaatcgacaaaataaggaggattagaaacaattacgtcgaatttatccgaagacctgtatttcctaaaatcagcctgcaccacctctacccgctccttccagggcgaacgaataacattttccctggcttgcccgacagccgcttcatctatttccaacgctacaatatttgcatccggcaaactgcgttgcgccaacattaaagctaccaaccctgttcccgtcccaatgtccaaaatccggtgcgcactttcaacggaagtccaagctcccagaagcaccccatccgtaccgactttcatggcacatttatcatgccataccgtaaattgcttaaattgaaaataaggattcgacattttatccgtttatcttaaagccgttttatactattattttattgcaaatcgccaaaaataaataataattatggaatactccctttacaagccgatattttggcattgtttttgtgtttttattctacgcagtgctttattattagagagaatcaattaactttgcaaacgatttatgcatatcagtatggcataaactaaattaaaacgaaaagatgaaagaaagatatttattggaagatggaggcgataacagcttctcgctaatcacagactatgatgggaacgatgaacaagcatttgatgtaaatgtgaaatctggtgaaattcttccggtactccccttacgtaatatggtattgtttcctggagtattcctgccgatcacggtaggccgtaagtcttcactgaaactcgtacgagatgctgacaagaaacataaagatattgcagtagtatgccagagatcggcacatacagaagatccgaaactggaagatttacacaatatcggtaccgtaggacgaattgtgcggatattggaaatgcccgatcagacaacaactgtcattcttcagggaatgaaacgtttaagtctgactagcatcatcgaaactcatccgtacctgaaaggtgaaatagaacttttggaggaagatgtccctggcaaagatgataaagagtttcaagccctggtggaaacttgcaaggacttgacaatgagatacatcaaatcatcagatgtgatgcatcaggattcgtcgtttgctattaaaaatatcaacaactcaatgttcctggtcaatttcatctgctcaaacctgccgttcaagaaagatgagaagatggacttgttgagcatcaactcattgcgtgaacgcacttatcacttactggaaattctgaaccgtgaagtgcagttggcagaaatcaaggcatccatccaaatgcgtgcccgcgaagatatcgaccagcaacaacgcgaatacttcctgcaacagcagatcaagaccatccaggatgaactgggtggcggcggtcaggagcaggaaatagaggaaatgcgccagaaggcagaaagaatgcgctggaatttagaagtcagagacacgttcatgaaagaacttgccaaactggaacgcactcatccgcaatctccggattacagcgtacagctcaactatctgcaaacgatgctcaatctcccatggggtacttatacaactgacaatctgaaccttaaaaacgcagaaaagacgttgaacaaagatcattacggactggagaaagtaaaagaacgtattttagaacatctagccgtattgaagctgaaaggtgatatgaaatcaccgattatctgtttgtatggccctccgggagtgggtaaaacatctcttggaaaatccatcgcatctgcgctcaaacggaaatatgtacgtatgtctttaggcggtgtgcatgacgaagcagagattcgcggtcatcgtaagacttatattggcgctatgccgggacgaatcatcaagagcttgataaaagccggtgcttctaatcctgttttcatcttggatgaaatagacaaggtcagtgctgaccgtcagggggacccttcttctgcattactggaagtgctcgacccggaacagaatacatctttccatgataacttcctggatgtagactatgacctctccaaggtattgtttattgcaacagccaataacctgaatacaatccccggcccgttgctcgaccgtatggaattgattgaggtaagcggatatatcacagaagaaaaagtagagattgcccgcaagcatctgctccccaaagaattggaagccaacggacttaaaaagacagatattaaacttcccaaagatacactggaagccataatcgagtcatatacccgtgaaagcggtgttcgtgagctggaaaagaagatcggtaagattcttcgcaaatcagcccgtcaatatgctacggacggttatttcgccaagacggaaatcaaaccgacagatttgtatgatttccttggagcaccggaatatacacgcgacaagtatcagggaaatgattacgcaggtgtagtcaccggattggcatggacagctgtcggaggcgaaatcttatttgtagaaaccagtttaagccggggcaagggcggacgtcttacattgaccggtaacctgggagatgtgatgaaagaatctgctatgctggcacttgaatatatcaaggcgcatgcttctgtccttagtctgaatgaagagatttttgataactggaatatccatatccacgttcctgaaggggctattccgaaagatggtccgtcagcaggtatcacgatggccacttcactggcttctgccctgactcaaagaaaagtgaaagccaacattgccatgacgggagaaatcactcttcgcggcaaagtgcttcctgtgggtggcatcaaggagaagatattggcagccaaacgtgccggaatcaaggaaatcatcatgagtgccgagaacaaaaagaacatagatgaaattcaagatatttatttgaaaggactgactttccactatgtaaacgatataaaagaggtattcgctattgcattgactaacgagaaagtagcggatcctattgatttatctgttaagaaacccagccaggaatgacatttgagttacaatatacagacactaaaagtaatgcccgtgccggtctgataacaacagaccacgggcagatacaaacacctatcttcatgccggtgggcacactgggcactgtgaagggagtacatctgaccgaattgaaagaagatatccaggcacagattattctgggtaatacctatcacctctatttgcgtccgggactggatgtgatcgagaaagcaggcgggctgcaccgtttcaacggtttcgaccgccccatgctgactgacagcggtggttttcaggtattttcattagccggaatcagaaaactgcgtgaagaaggagccgaatttcgttcgcatatcgacggaagcaagcacatcttcactccggagaaggtgatggacatagaacgtaccatcggtgcggatattatgatggcttttgacgaatgtcctccgggcgactcggattacgagtatgccaaaaagtcattaggattaacccacagatggctcgaccgttgtatacaacgttttaacgagacagaacctaaatacggttataatcagtctctcttccccatcgtgcagggatgtgtttatcccgacctgcgcaagcaatctgcagagtttgtagcgtccaaaggtgctgacgggaatgccatcggtggtttggcggtaggcgaaccggtagacaagatgtacgaaatgatcgagattgtcaatgaaatactccccaaagacaaaccccgttaccttatgggtgtcggaactcctgtcaacattcttgaaggaatagaacgcggcgtggatatgttcgactgcgttatgcctacaagaaacggacgaaatggcatgttgttcaccaaagatggcattatcaatatgcggaacaagaaatgggaaacggacttctctcctatcgaagccgacggagcctcttgcgtggatacattatacagcaaggcttatttgcgccatcttttccatgcgcaagagctactggctatgcaaatcgcttccatacataatctggcattctatctgtggctggcaggggaagcaagaaagcacattatcgccggagatttctcgacctggaaaccgatgatggtcaaaagagtatcaactagattataagaaatgaaaagcaatcgatttataaaacggctggactggtatatcatcaagaagttcttggggacatacgtatttgctattgcactaatcatttctattgcagtggtatttgacttcaacgaaaagatggacaaactaatggagcatgaagctccatgggataaaattatctttgaatactacatgaactttatcccctatttctccaatctgttcagtccgttgttcgtattcattgctgttattttctttacctccaaactggcagaaaactccgaaattattgcgatgttctccaccggtatgagctttaagaggatgatgcgcccttacatgatttctgccgctatcatcgccctcgtcactttcacactaagttcgtatgtgattccgaaaggaagtgttacgcgtctgaattttgaagaccggtatatcaaaccaaagaaacaaaactcggtaagcaatgtgcagctggaagtggatagcggagtgattgcatatatcgacaactataacaacgcaatgaaaaccggtaaccgcttttcattggacaaatttgtggataaaaagctggtttcacatttgactgcacgacggattacctacgataccaccaccgttcataaatggacgatccacgattatatggtacgcgaactggatggtttaaaggaaaagatcactaagggagaccggatagactctatcatcaacatggaaccttctgactttcttatcatgaaaaaccagcaggaaatgctgaccagtcccgagttaagcgattatatcgccaaacagaaacgaagaggatttgccaacatcaaggagtttgagattgaatatcacaaacgaatcgctatgtcgttcgcctctttcatccttactatcatcggtgtatcgctttcgtcccgaaaaacgaaaggcggtatggggcttcatctgggtatcggattaggattaagtttctcttatatcctgttccagacgattacttccacctttgccgtgaacggaaatgtgccgcctgccgttgcagtctggattcctaatatcctttatgcgggtatcgcattcttcttgtaccagaaggcacctaaataaaaggtaggcaagccttccgcagtcttcacggattctatccatagattgccctaaggttttggatgcaccggataaacgaagagtataaaagtagaagttccgcctattcttgctaatgcaagtgtaggcggaacttttttgttgtatccatttcctcttttgtctattctccattattttcacctgacggtgatttggaaaatccctctttctccttacattcttaaaatcgttaaccgacttcttttacataagcagaaagatctgcagcagagatgtttttggctataattacaccatttccatccaataaatagttagtaaatccccggtttaaacggtacttcttaaataaaccggaatcctcgccttctgtttccacgaaacaagtgggcgtaactatttgatccttacgaacggtttccttaaatattgactgatattcgtcaaatgaaatagaaaccatttccacattatgagaagaacgaagcgcattgctcaaacttacattttgcatccgggactgcgcgtcataacttgcccaaaaacttagcaacacatatttacctttcaaatttcccaatttaaaggcgggttgcccgtttgacgtagattcgattttaaaatcaggggctacgtcaccctcactcaaacctccggtaggtttgtctttctcaacgaaagcggtcaaggaacaaatcagtaatacaacaaaaatccattttacatgcttcatgtaattcggttttagttaatactatccgggactgtccttaaacagtggtttcttcccgaaacgttgtcttttcaggcatcaggcgaagaggaatccgctgattatcagagcctttatttttgaaaccgggtgcaaaggtaagtaaatattaaattaacttccaagcaaataagcaaaaatcttacttttggggtataactttttatgttatttagcataaaaacgaacttttttctctacttttgcagcgttaaagtctattttttatgcaaccatcaaatactgaattgattctgattcgagttaccggcgaagatcgcccgggactgactgcttccgtgaccgaaatccttgccaaatatgatgccacgattcttgatatcggccaggcagatattcataatacattatcgctgggtatcctgttcaagagtgaagaaagacattccggattcattatgaaggaactgttgttcaaggcttcttctctgggagtgaccatccggtttgaacctatcaccaccgagcaatatgaaaactgggtaggtatgcaagggaaaaaccgttatatcctgacggttctgggacgcaagctttccgcccgacagatttctgccgctacaagcatattggccgagcagggcatgaatattgatgctatcaaacgtctgacaggtcgtatcccgttggatgaatgtcaggcagatgcacgcaccagggcttgcatcgaattttcagtgagaggtactccgaaagatcgcattgcgatgcaggagaagctgatgaagttggccagcgaactggaaatggacttttctttccaacaggataatatgtaccgtcgtatgcgccgtctgatctgttttgatatggactctacattaatcgaaacagaggtgattgacgaactggctatccgtgccggtgtaggcgacgaagtaaaggccatcacagaaagcgccatgcgtggagaaatagactttacagagagctttacccgccgtgtagcactattgaaagggctggacgaatcggtcatgcaggaaatagccgagagtttgcctatcacagagggcgtagaacggctgatgtatgtattgaagaagtacggttacaaaatcgccatcctttcgggaggattcacttatttcggtcaatacctgcaaaagaaatacggtatagattacgtctatgccaacgaactggaaattattgacggcaaactgaccggacgttacctgggagatgtagtagacggaaaacggaaagccgaactgctccgcctcattgcacaagtggaaaaggtggatattgcacagaccatcgccgtaggagacggagctaacgacctccctatgctaggggttgccggactgggaattgctttccacgcaaagcctaaagtggtggcaaatgccaagcaatcgatcaacaccatcggactggatggagtgctctatttcctcggattcaaagattcttacttgaatatgtaattagaccaaaaaatagattatctttgctgacaaattaaataaaagaatgaagttttccgaactacaattaaatgcaaatgtgcttgaggcgcttgatgccatgcgatttgacgaatgtacgcctatacaggagcaggcaattccaatcatacttgagggtaaagatttgatcgcagtagcacagacaggaacaggtaaaacggccgcgtttctactgcctgtattgaataaattatctgaaggtaaacatccggaagatgcgattaattgtgtcatcatgtctcctacccgggaattggcccaacagatcgaccagcaaatggaagggttttcctatttcatgccggtatcgagtgttgccgtatacggtggaaatgatggaatattgttcgaacaacagaaaaaaggactcactttaggagctgatgttgttattgctactcccggacgtctgatcgcccatttaagccttggatatgtagatctttccaaggtttcttattttattctggatgaagcagaccggatgctcgacatgggattctatgaagatatcatgcaaattgcgaaatatctgccgaaggaacgacagacaatcatgttttctgcaacaatgcctgcaaagattcagcaattggcaaacacaatcttaaataatccgtcagagataaagctcgcagtttccaaacctgcagaaaagattattcaggcagcatacgtttgctacgaaaatcaaaagctgggaatcatacgcagtctttttatggatgaagttccggaacgtgtgattgtctttgcatcttctaaaatcaaggtcaaggaagtagccaaggctttgaaatccatgaaactgaacgtaggggaaatgcattcggatctggaacaggctcaacgggaaactgttatgcatgagtttaaagccggacgaatcaatatattggtagctacggacatcgttgcacgtggtatagatatcgatgatatccgcctggttatcaacttcgacgtgcctcacgacagcgaagactatgtacaccgtatcggacgtacagcacgtgccaacaatgatggtgtagcacttacgttcatcagcgagaaagaacaaagtaacttcaaaagtattgagaactttctggaaaaagagatttataaaattcctattcctgaagaattgggagaagctccggaatacaaaccgcgttcttttagcaagggcaagggtggcaactacaaaagaaaagatttccggggaaaaaggaataataataacggaggaaagagaaataaccgtccgtctccccccagacaaaattaaagcaaggcttttttaatccggcactatacgatctgaatgtatggtgcttttttatttggatgaagtgatagtcaaatctcctttaaaacttacttccatatttacaatgctatatatggaagtttccggaatggccaggacagcttgataatgaaaaccgttccggtctactttcataaactttgtatctgacaggatggattgctccagaaaatcgacaggaagtactttgtcaaacatctgtttggtaacatcgctggcaaacaggctctttttaccttcatacacacaaatgtgcatcacattatcatagtatacattatccatgctaatcccgtcttcggaataagtcgtcttgatgactctcattttagaaggattaatatatacgtatgcgcgatagcgagtgccattataggtcactacactatcgcgtttggttacttccgtatatgccggaatgactaattcctgacggacaaaatagattgaatcattggcatcttcggatttatgcaacttaattacatcatccgttatggaatgaaaccagaatatatgttctgcctgcttatcaatcttgtaataagtagtatcatttccataagtataaagagtatcccgtattattttaaatgcaatgggagtactttgtacatctgcatagtagatagtatctccttctacacgcatcaacgggctctccgtttcatcgtccagccaaattccctgcagtagtccttttgcactaagatcctctttctcttgttgaagagaatggggactcttattgccgctacatgccgcgaaaaagattgccattaacgatacagccacatttttcatcatctattttagtttttatataaagatactcttatttttttatttaccaatacagtgataaataaatccgagttcttccatctcttttttatcatatatattacgtccgtccaacacaatctgccgggacatcgttttcttgataacggcccatgaaggcagacggaattctttccattcggtaaccaacatcaacacatcagcatccagtacggcatcatacatatcgcaagcataatagatagtatcaccaatcctgcgcttacattcttgcacggcagccggatcgtatgcgcgtactttacaacctgctttcagcaatttatcgatcaggactaatgccggagcctcacgcatatcatccgtttccggtttaaatgccaatccccacaaagcaacagtcttaccctgcaaatcaccattaaactgtttcattaacttttcgaacaagacgcttttttggttctcattcacttcttccacagccgtaagtacccgcatggtataaccattctgttctgctgttttaatcaatgccttcacatctttggggaagcaggaaccaccatatccgatacccgggtacagaaacttacgtccgatacgagtatccgaacctatcccactacgcaccatattcacatccgcaccaacaatctcgcacaagtttgcaatatcattcataaagcttatacgggttgccagcatcgaatttgccgcatatttagtcatttccgcagacggaatatccatgaaaatcacacggaaattattcaataagaatggtttatatagtttggacatcaatttctccgcacgtgccgactccactcccactaccacgcggtccgggctcataaagtcactgatagcatttccttctttaaggaattccggattagaagccacatcaaaatcaaccgtcacgcctctcttatccagttcttcctgaataaccgcacgaaccttactggcagtgcctaccggaacggtacttttggtaactaccaatttatactgtttcatattgcgaccaatggtacgggccacctccaatacgtatttcaaatcagcgctgccatcttcatccggaggagttccaactgcactgaatataacttccacttcatccagacaactttccaatgaggtagtaaacttcaatcgctttgctttcatattacggagtaccatctcttccaatccattttcataaattggaatgttccccttttgcaaagattcgattttctctttgttcgtgtctacgcacgttacattcacgccaatttcggcaaaacatgtgcctgacaccagacccacataccctgttcccacgattgcaattttcatacttaatctattgtttgtttagaaattcattcaaaataaacggcgtccttgaaagcagttccctctctgtctttcgcagataataacatttgcgactctgccaacggccagtcgatccccaatgcttcgtcattatataaaatagaggcttctgcctgcggagcatacttgttatctaccttatatgtaaaaacagcttcttcactcaagacagcaaagccatgagcaaaaccacggggaataaaaaattgtctcttgttttcttcactaagcaatacacaaacatgctttccaaacgtaggcgatgatttacgcaaatcaacggcaacgtcgagcacttctcctttaagaacacgaaccagtttcgcctgactatgttctcctttttgatagtgcaatccacgcaatacaccaaaagatgatttcgactcgttgtcctgtataaagtttacgggaccaatattggcttcaaactcttctttcttataggcttccataaaatagccccgttcatcggagaaaactctaggctcgatcagccatactccgtctatttctgtctgtatatagttcattattgatagtgataaataaaacgatgcaaaagtagtgaatttttcgaagttttctgggatatattcaatttatctcttaattttgcagacatgattgaattggcacaacatatagagactttactactggaaaacgactgcgtcattgttccgggatttggtggttttgtagcacattattcgcccgcaacccgcgtaaaggaagaaaatatatttttacctcctacccgtataatcggttttaatcctcaattaaaactgaatgacggcgtactggtgcaatcttatatgtcagcatacgacacaagttttgctgacgccagccgtatagtagaaaaagaagtaaacgaatttatcggtctccttcatgaggaagggaaagcccatctggataatataggcgagattcattataacatttatggtaactacgagttcgttccttatgattataagataacaactccttcattgtatggtctcgactcttttaaaatacatgaactttcggctctgcagcagaaagaaaaagtattggtaccgacttatcaggaaaaggaaaagaagacttttgaaattagtatcaaccgcgcgtatctccgcaatgctgcagcaatgattgctgccatcgtactgttctttgccttttcaactccggtagagaataccgacgttcaaaagaacaattatgcacagttattgcccagcgagctttttgagcaaatagaaaagcaatcggttgcagtaactcctgtttatgttaagaacgatgttgcgcaacaagcaaagaagctttctgcttcttctgcttcaaccaaaacttcatctgctaaaaagcatacaacggataaagccaagacttccaaaccgatcgcagtaagagaagtgaaagtggtaaaacaggaaacagcgactcctgctcctgcggtgaaatctcaagaaagtgcaaatcatccttttcatatcattgtggcaggaggaatcagcctgaaagatgcagaagttattgcgaaccaattaaaatcaaaaggatttgcagatgcaaaagctctgaacactgatggtaaagtacgtgtcagtatcagttcatttaacaaccgtgatgaagcgaccaagcaattacttgagctaagaaaaaacgaaacttataagaatgcctggttactggctaaataaaaatcccttttaaaaagcatgaaacgagttctttgtcctaaatgtgagaattatctttattttgatgaaaccaagtatagtgaaggccaatcactggtatttgaatgcgaacattgtggcaagcaattcagtatccggttaggaaaaagtaaagttaaggctcttagaaaggaagaaaacctggaagaagaagctgaatctcataaagaagagttcggatatatcactgttatcgaaaatgtatttggttttaaacagttacttcccttgcaggaaggtgacaatgtcataggccgccgttgtgtaggaacaaacattaatactcccattgaaagtggtgatatgagcatggatcgacgccattgcatcatcaatataaagcgtaataagcaaggaaagctagtctacacattacgagatgctcctagtctcacaggtactttccttatgaatgaaattctgggagataaagaccgtgtacgtattgaagatggcgctattgtgacaattggagctactacatttattttgcatacggctgaacaagaataataaataacttgataataaaaaatagcgccacttgttcagagaacagtggcgctattttttatttagtcttctaattacagaatacctttaacggtctcaagcattcctttttcctggatagaatccaaatcagcttttacggcttctgtcaatcccgggatcttattcaaatcttctccccagataaaatctgcagccagaacaccttcggcaactttctttgtgcaacctgttgcccaaagttctttcagtaggttcatgatttcaggagcatcattcggaacaatttcagcaccatcagcacgtacaccacctttataataagtaatgatagcggctaaaccaagtaccagtcctttaggaagttcacctttacgttccagataagtcttcaatcccggcaaatcacgagtttcgtatttagggaaagaattcagcatgatgctggttactgcatgatccacgaacggattgttgaagcgttccaatacatcatttgcaaatttctccaactcatccttcggcaagttcaaagtttccatcagttcgtcaaacattaccttgtggatatatttgccaatcacttcgtgctggcaagcatcacgtacaatattcactcccgagagataggcaaccggagaaagaacagtatgcgggccattcaacaaagtaaccttacgttcgtgataaggagcctctgacggtacaaacaatacattcaagcctgccttgtcagccgggaactcttttgcaacttcctgcggagcttcaataacccacaaatggaaaacttcagcctgaacaaccagattatcatcatattgcagtttttctttgatagcagcaatatccttgcgcgggaatcccggaacaatacggtctaccaatgttgcatatacaccacaagcttcttcaaaccaagttttaaactcattacccaggttccacaattcaatatattgataaattgtttctttcaacttatgaccattcaggaaaataagctcgcaagggaaaataatcaaaccttttgtcttatcaccattgaatgttttaaaacgatgatagagtaattgagtcagcttacccggataagatgaagcaggagcatcctcaagtttacaagccggatcaaaagcaataccagcctctgtagtgtttgaaataacaaaacgcatttcaggttgctctgccaacttcataaactcgtcattttgagtatatgggtttaaagcgcggctgattacatcaatcattgtcaagctgttaacagcctctcctttatccaatccttgaaggtttacatgataaagatcatcctgtgcattcagcatatcgaccatacctttatcaatcggttgaaccactactacactgctgttgaaatcagctttctggttcatgttataaataatccaatctacaaatgcacgcaaaaagttaccttcgccaaattggataatacgctccggacgttgtgttttaggagcagtttctttgtttaatgctttcatgttagttgtaatttataaagttgatattatacaaattcaaaataaaaatcaatgttttcctttatcaggatatcaataggcatgtattttacaggttcaacagacttcttaaacacgacatgatcgcacaaagccttcaccccacaatatccttgcaaacccggacgttgcccgattaaataatgcacatcaccggattttaataaatctacgtttgctttcagaaggtcatatcctatcagtcctttcatgctacgtcccgcatgacgaagatactctcccaactgatacactctggaattaaatacaactcccagtaaagccttcggatgcgcctgaaaaaactcatccaatgtctgttggttactttcctgatcggatttattaagtactacctcatggattaccaagttattatattcttcggcaatgtaactcataaaaccatccaaacggcgttgcatctgtatttcagccggattatctttattgttacttaaaaacaaaaccaactcctggccttctcctgccgaataattgcgcatcaatattttcgctgcgatatatccgctcttatatgaatcctgcccgatatacgtcaacgctttcgcttcttccatattgaaatcgacaaaagcataagcaatcttattttcctgtaaataggctgtcagcgccagtgtctcttcccgaaaattcggagaaatcaataccgcatccacattcttttcttttatagaaaggcaggcttcctgataactcttctcatccccatggtgatagcacaaataatctatactcacattaaaaggacgtaattcttgccggacacgctcaatcccccctactaccgaatgccaataatcatgctctatataataaggtatcaaacagaggaaagaatatttctttttagcagccaaaccgatagcaaacacattgggctgataatgaatctcatccaacaccttttgtactttggctttgcttttgggagacacgtcaccgcgattgtgcaacaccctgtcaaccgttccggcggaaacaccggccatacgggcaatgtctttaatggtatagttctggtcctccatagtgctaaaacttaaatattataaataatcgctgcaaatatacgaattattttgttactccaagtaaattttctatttttgtgttcgataacggttaataaaactaaaacaagatttacgcctattagctttaaaatcaatactatataggtataaatatagaaagtaataattttatatacttaaaacacagtaataatgaagaacttcatggacgaaaacttcttgctgcaaacagaaactgcgcaaaagttgtatcacgagcatgcggctaaaatgccgatcatcgactatcactgtcaccttatccctcaaatggtagctgacgactacaagtttaaatcactgactgaaatctggttgggcggtgaccactacaaatggcgtgcaatgcgtacaaacggtgtagacgaacgtttctgtacgggaaaagataccacagactgggaaaaatttgaaaaatgggcggaaacagtaccttacactttccgcaacccattgtaccactggactcaccttgaactgaaaacggcatttggtatcaataaaatattgaatccacaaaccgcacgtgaaatttacgatgaatgtaacgagaaactgtctcaacccgaatattcagctcgtggaatgatgcgtcgttatcatgtagaagccgtttgcacaacggatgatcctatcgattcattggaatatcatatcaaaacacgcgaaagcggatttgaaatcaagatgttaccaacatggcgtcctgataaggctatggctgtagaagtccctgcagatttccgcagttatgtagaaaaactggcagaggtaagtggtgttatcatctccaactttgatgatatgatcgctgctttacgcaaacgtcatgacttcttcgcagaacaaggctgccgtctgtctgaccatggtattgaagaattctacgcagaagattatacagatgctgaaatcaaagccatctttaataaggtatatggtggcgcagaattgaccaaggaagaaattctgaaattcaaatcggcaatgcttgtgatcttcggtgaaatggactgggaaaaaggatggactcaacaattccattacggcgctattcgtaacaataacacgaagatgtttaaattactgggtgctgatacaggtttcgattctatcggtgaatttacaaccgccaaagcaatggctaaattccttgatcgcctgaacactaatggcaaattgactaaaacaatcctctacaacttgaacccatgcgccaacgaagtaattgcaacaatgctgggtaacttccaggatggttctatcccgggaaaaatccaatttggttccggatggtggttcctcgatcaaaaggatggtatggaaaaacaaatgaatgctttgtcagtactcggtcttttgagccgcttcgtaggtatgttgaccgactctcgttcattcctatcctacccgcgtcatgaatatttccgccgtacattgtgtaacctggtaggacgtgacgtagaaaacggagaaattccggtatctgaaatggagcgtgtaaaccaaatgattgaagatatcagctacaacaatgccaagaacttcttcaagttctaatagatagtagttacactataaaaaaaccgctaccaaagtcgaatatagctttgagtagcggtattttttattcctacagctgaacagtaacaccccaaaaagctcttaacaaaaaaggagaaccttttaagttctccttttaataatctttgtacaccctcagggggtaaaattgatgttgatagtcagataattatacatttggtatcattttagtatcacatcccaatatttcaattcatctacattaccaaccataggttaataaatgtaggatagactcacttgttttatgtttcaaagatacaaaagtttttagactatatagatttaattagagattttattttcgctcttctaagtattttcatcggtcatactattttgaataacatctgatatttgttggagggagtcaacagataactgaaaaaggtctactgactttatctcggttataagttgtttctttcttatcatttcaaaatattgcttttccaaactttcagtaagtactgaaatgtaactactaccccatgtatctgccggtatctgacgaccattttgctttctaaacttttcggttccacaaatgatagtagttgaggtaacacggtctactttgagtatttttgaataataacgagaagtataatacactttatctcccgcttctatctcatccagtgattttttcattttctgttttcttattataaatgattcgtaatgtttacaaggtttctttctggctgtaattcgtctttttaagactttacaatacatatagaaattcgtactttacactcgctacaatgcctatcatcatcttctttcatgtcttttatttcagatattctttattaaaatgatgatttttaatgagccattctataatagacacacagcattcaattggagtatcctcgatatgtgtcccaaccaaacaatctgctgtatatctccgaattgacagattatatcccaaagcatgttttatcagttctggatgatgtgcttcaaatcctggtttaggatctggaacttcattaggcagcatttccaacagtctcgataaactccatgctggaatatccctaccccatatttcatcaaacgcttcttctccggtcatagacgttccatccggatgcttatgaaaaggcaattctaactttgctattctttgaggtgtccaaaatttacctctcaatgttggtggagttgtttttaattcccattccaatgcaggtactttacttttggtataatgatataccatatcagccgtttcaggttttactcctaaagctatcaatcgttctgattgttctttatttgtagatattggtgatgtaaattttttcattttgttctataattatctaattaaaacctcaatccaatccccaaacaagcataacgcttataatgggaaatgtggattgaggcttggacataataaaagttgttgttttatgaatatacacttagttgattaaaaggaccaggttactgaacgatttcccagtcttcagcaaacacatcgctgattgacggaacccaactgtcagcatgtccggtattctcgttgtaaataaggcactggcttgtatagtcaatgaaacccttgccttttaaaataaggtcttttgccgattgaggaagtgactgcatcttcggaacaatatcgctttcgatgtgtgccgggacttgcttgatgacccacagtccctttccattccaaccttttctacgaatagcaagaccaaatttcaacgcttcgattgcaactccgaaagacatcctattaaacggagcgttaggagcaccgtcaagacatccaatacgacattcaagtgttttcacgtaattacccatcactacttgctgtaagcgtaacaagaatttttggtagttgtctgttaccacttcatccatctttccagaatcaatgaaaacaacaagtttatccaacctgtcatacaagtctttcatttcaatatgcaaacgatcaagaaaggtgtctgcacacttatacgatttctcaaacggtttggcaggcgaccagctttcgtaaccatcttcgtatttaacacgataaccttgctcggtttcttcatggttttcaatatccttaccataagaatttctacccgtttcttgaacgaagtcgcccaatgtcataggctcggcttcaatctgttttgttccaatatactttttcataattgaattattatattaactgtaatactttgacaaaccgttttattattcaacatttttatttttacgcggtcaatacctacatctgtgatttgtacgcatgactcttgctcaaattcagcaactttagctgcaatatctctttcaagaatagctttcattttcctgatttcttctattgatttactcattgattaacttcatttaagtttaactttctaagagctgtcagttgtccaggattacttgcacagattctatttcctttcatcattagttgatcttcaattactcttaatagtatttgcgaaaaaatactatttgtgatgttatgaacgaaaacaaaaatgttaaggctatacagtaattaggaagcccaagccaactaacaaattcggtgagtgcacaagatattgcccatatacataaagcaatgatagttccttttaattcaatatagagtttatccataattattttacttaaacacatttagaaatgccttaattgtctggcgcatatcatacacgcactgtggaacaatgtccttttctggaaggctatcagcaagtatcatatcacgcaccatagttgctgacacgccatcttcacaagtgtttctggcaagtaaagatagagacacgttattccttaaaaggaatcctggaaaccaagatgtgatggtctcaaatccatcagagtaatagattgtgaaatcagattggttgattttgctaacaataaacgaataaagataaaaaccccaatcgtggctgttgtcagattcatcagaaaggtcagcaagctcaacaatcttcgttttttcgtgaagagaatggtctttaatcgccttttcaacaagttgttttcggatagtccaaggtatcggattccgttttgagagtttatctattgagccaataataactaaaacttgctcattctcgtcacaagccttctttatcagctgtaggtgtccattgtgtataggctggaaccgagccaatattactccagttttcataattactatttttatcgaaaataattagttactacttccatttccggacactttaagttgattgttcacaactctattaggataatttgttgaggaagcagggagaatcgaagacccagccactttatagcaggacattaacagtgtgttactttcattcacccatacttcctttacaaatgacagctttttgagcaaaatatttacctttgcaagcaatatgactaaacctacgggtaaatcgaatcattttagccaagagcgaagagacaatatagttgcaatctgtgttgtccttcagacagttatagctgtcatatctcttttgattcaactttgcgaatagccgctgtcattttgatttcacaaccatattagccctatggttgtcatctttggggagtaatttcaactccccattttttatgaggcccatgcaggaatcgaacctgcgatcatggttttgcagaccattgccttaccacttggctaatgaaccagatagctggaagtttcacaacttcacagcttcgcggaaagaaaaataagctaatccaataacaatctttttaaccttaaatgcgctcttagatggatttgaaccaccgacctgatgattaacagtcatctgctctaccactaagctataagagcaaatgatgtctttatctccctaaccgacccatcccctttcggcgatggtggaggaatcgaacactcccataaagacatctaacataccgattctaccaacagctcggtatcacactcccggaccaacgattccggacagggcttagtttacttgtatattgacttgtctcaacataacctgcatgttcgttcccttgtacttcgggcttgttgtactcggtaatggagtcgaaccattcttttctgctcgaaaggcagatgtcctttccgatagacgaaccgagcaaacagccggatttttcaccggcttttggccaaaaagttttaactttgcagccataatggaaatttatttgctgttgcttgtcctccttgtacgggaaattcgcgccctcgtaaaggaaatcaaaagacgataagccgtccgtaggacgtaaaaacaacaattgagctttcttgccatttggaatgtgaaatacgatcggttcacaggcattcaagcattttacataatttccatccagaggaataaaggggtgcaaaacatttttccaagatgtttcttaacaacccatgcagccatcccagcgaaaccaaagttggaaactacatggatcgcacccctcctctttccaatttatttatgagttttaattcgtcatcttcagaaattctggaattaccccatacagcggtgtttttccgtcccatttatcaataaactgtttatatagaatttctttagttaaccctttcgatgtgataagagcctgttcggtttttaatctttccagttcgttttgctttttctgctcttcgattttctgatcaataacggaaatattagtgttaacctcgtttctattatcaatcttttcccggactcgatcactaaattctaattgggctgaaaatgacttcaggtccaatcctctatctttaaattccgccctaacaatatcctccagcttcttctcaaaagctaaagaacccccatcagccataagtgtatctgttttatatttccggctttcttctttaataaggtcgtaaatacgtggttccagaatattatcttccaaagatctcataaatccatctccgtttccgatatgtttattatcaaaaacaacgtcaattgccttgtctttgataactctatatgagtataacggagtagcattgaactctgtattgtcagcagcttttagggtaactgatttctgaaatcctccacgctgttcaaacaatggcacctgaaacaactctgttccccattcccatgtggaaacttttccggatacaatcttaaaatcttctttaccttccttaccataattctccataaggacaccggcatagttaggagcaacacgctcacaagatgaaaaaatcactgttgccataagagcaaccaacataaacttaatcttcgttttcatgttttttgataattaatttaatgatgttaataactggatagcaaaccccaaaacatatagcaattcccaaccaagcgtcaacatgattgaatactctattgcctatgaataagaccgctatcataaaaaagaattgttctatatactttttcatcgcatattaagtttggtatatttcaaagaactcttgttgacttatgtcattgtgccgcaaacaggagtcgaacctgcaccgtcctttcggacgaatggattttaagtccatcgtgtctaccaattccaccattgcggcatcatcttatcaagacttaaagaacaaagaaaaaatccggataaagaatgagtttcgggttttcatcttctccaactctttattgtcttttctcaatttcttaatgtctgccttattggaagacacgtgtgttttagctctcatattcaactccactaaggactgaaccaattgtctcaaattggcaataatatttgccctttcagatatgatttgctctttcatattataattaatttaattaggagattctactgtttgtaagttcaaaatacataactttgtatttgcaatggtaactaaaagcaaggagcactgccttgtgaatattgaagcaaagagaactaagacaaacattaaatccaatcaagttgaggtaaaacacaccgaaacttactttaatgtcagattgctcaatttatcctgcatcctaaaaggaatagagcgtttaatgtctttgtttaacttgtaatcaacagcagtgtcctatactttcaattgattattttgcatctaactctgtgtcgtggttggcggcacagtttttctttgtcgtaaaataacgcacccaacaagctaagattgataagaaatcagccatgcttgataagatagtgcaaaaactcaataacagccccattaatattagtacacaagttatctcacttccactaacatatatactcaaagttgtccaagtataatcaataccacagctttgatatacttccgtaatggccattacgaagaaatatatacaaaagagaaattggaataagagccataaagttttaactttcttattaccaatgcgaaatttaatcttcatattgtatttattttcatttgtttccaaaatcagcaggggtctcaccccattctttgttgttccagtgtcggacttcaatcgtatcaacatcccatgcaagagttttaagaaatatctcggctttctgaagttctttgcatttcttcttggatgctgtttttttgttttgaaaccaagctatagctgttatactatctgtatagataattctgggagaataatcattttctatgatatattttgctgcttcaacaacacctaagaactcaccaatattcaccgttttattacccaggttttgataaaagatccgcttaccggtccgtaaatctatcccctgaaactctgttattttatttttcgtggaatgagctgcgtctgtagctattccctctactggaatttctatcatattctaccaatattgagcgggtgtgggaataagagccacagcaccatttatcattaccggttttatttctactgtcgaattaacccaaaatttacaaggccactctccttctactttagcaagattaacagtgctataatacgaagcacgtccttgtgcttttatacaagccttttttctttttctcggaagcttaggttttctactttttgagaactttttttgctgcgacataatgaccatcgttctggaatgcggttaatacaatgtttgctgacttacagaaatcatcaattaccagcaatagatttttgatgtctttacgttttgacagttcctctacaaccccatcaatagtacgaacagaatctttgaccccatccagcggatcgtatttgattgtcttgtttccgaactttacttccactaaatacacagcgttctttacaactgtagaagtaatctttgcatcaaaagcatgtggttccgctgctacaacgatgtatccagccttttcatttttcataggaaccatttgtacatcataaagcacattcggctcaataattggctctagctcatgtgttacaatacatacttttttaggaccctttgcgtcttctctaacgcccttaatgtaaccggttttagtattgatagaaacaaatcctacccatgactctgtacggtctgacttaataaatttcaattttgtttttatcttatccatattcctatgatttttgtttacatataaaagcctcaccaactattttgttaagatggtgaggcaaaggtacgactttgttttaaattatgacatcaatttattaattattttatatttaatcagctgtcacacaataaattagctatatataaaaccaaatataatacttaatataattgactatattacagatatttacaaaaatcactattagtatatcgaaaatgtcaataatcagcttcaatatcatccaaaatttgtttcacttttggtattgcgaataccccattttcatctcgatattctatagtcttaaccgagataccaatctgtacaaggaacaacaaggtgttttcaagttcataatccgggaaactacagaatttcacgccctcttgcagatgtactgggagattcagcactgcccccagttgaatagcatcatcttcataagcctcaaaacgagattgaatatgaaataatactaaaccatgtgcgtactcactcttatagaacttatacgcttcaatgtacagattgtccataatttataattttatttgtttagaaatacacttatcacatataccatcgttacgcatgtatttgactttcgataactggagcccacattgcctacaataatatacgcgcttgggtttaacttttatcgcatataaaattttacgtttattgacatcatatataccagaaagtttttcaagtatctggttatgtgtgaatttgtttgttttcatcaatttccaataatcatgtcggattaacttatctcttgcttctttctgattcaacaaaccattgtctctcaatgcaataatataaggatatggaatattggttatatccgaaatcttttgagcatacaagtcataaatctgtgcatcactcatttctttatcactattttagtttgaaggattatagatttggagtcttcaatatcacgtataagattaaatgaatcttccaataaggccaacataacacgattactttcttcatgtgtcatattttcccagtcaatttctaattgtttagctatttctttcgctaactcataaaacttatttgtctttggaatatccgtgacatcatatatttcgttttgcttttgaccgaacaataaacggcttaactcataataacgaaaaaacgcctccaaagtcttcttcttatctggaggcgcaatagataatttgttttttgtcatatttataaatgattatatacgattatcaacgatttgtgtaattttgtaaccaacatggtaagattagtcatgttggttgcccttttagtagcaaacctcaccgatgcgcctggaatatcatggatcaattatgctattctggtttatgatattatttcagccgccatcgcaaggtttgcaggactaaccaaaaggagtcagaaagactctgcaaattgatgaattttatctgtatggctggagaatatatctccggccttttttaagtaatagttgaaactggatagaattagtttagaaaaccaagtacatttttggaaaattaattggctacaattgtattcaattatcaataaatagcagtatctttgctgaaacgattaataaatatttatcattatgaatatagaaattggagacagcgtaaaaattgtcaatgccattgatcccataaagatggttgttatagataaaatagacaatgatcatttaaccgcagtgtactggagtcatacccaaggagcatatcttacaataacaggaaatataaatgctttcgtaaaaattgactaacaagcccattgctttttataataaaatataggaacacaaaaaaaacgtatctcaacaacaatatacgaagaatcggtgtccctatatttttttgcttcaacaatagctttcatataacaaaattttagtttataacaatatcatattaaatagagacgataccagataccaaagtgctgatattgacaactacaggtttatacatgtctgaatgaaaaaattctatgagaatatcgtcaatagtttctcttattgtagatttgagagattctcttactttgtcatcttctattccattccctttaataacaatcgtttctgctaatttctctatattgagaataagcatttgagacgaatcgttttcatcttttattattgctacactttgatattccatattcttaaaatcattttctatagaataggaaagatgaaaaaagaatggttgttatttttagttatacaccagaatgacaaaatgaaaatctttcttagtatattacacaaaggactttggaagaattgcccattttagaggtataacttggcaaccatgccatttataatgttttactatgaatttcgttcaagtaactcctgaaagggaaaagtaaaataattttctaatcaacgatatttattatcgaagttgttgacagttcgttgagaaacatgcaagattcttgaatttatggtagataattaagagtataagcctcatatctaacataagttatatgaggctttacatacaccattccttattgtatttaaatatcgtctaaatcattttggattttggcttctacattttgggaatcacgatagcgaatcactaccataccttcataaacaccggaagacttttcaattgaaagttgtatatctccacctgttacttcccatgtgctaccatagacaaccgttccctggtgcacttccgccattagagctgtgttggaatctgaaagagctggattgttttcttttgaaaatgtcggttccccatatttgcgagtatataaatccttataatagtcataggtattaacaagagtattccattcactacttgcatcaaataaaacgattacagcaaaaacattttttccatcgtctgtcgcagttacacctaccgttgctttgcgccccgtaaagtctccagagaatagagttaaattcttttcacgaccaactgaagtaaatcctttagcttttagtttctgacagaactctgtcatgcttccttctattgggatacctttgaatgaaagatgatcctgtgccataacgttaatggtagcaaataacactgttaaagtcaaaataatctttttcatacttgttatattttaattggttatattgtggtcagcaactcaaaatcttcaatagatattttgtctattgagacaagccattcaagataagaaatatcatctttaatgtcacgaaacttttgtcctttatattttccaaaatcaattaccttgtctgcaatagatacatcttcctgtttttcgacatctggatataattgtttaagctcctcaaaatcaactttgaaaagcctgtctgttttttctagccaatgaagatattgataatctatcttataaatgtcgccataagttttacccttatatttaccaaacataagtatctcatccgctttatgaatgggaaatatttcatcaagcgatacaccaggaacatcaatcaaaacccattctccacatccagcgcaagggatttcttcgtctttgatatttggataacattcttgcctatatgtatcatcaggcttaccatttacaaaacacttgccataagccttaccatatttgccacgcggctttacagtttcgactaagaaggttctatcttgatttgggtcaatacgtctttcctcgctggatgaacgtgctaatcctaactcacatcgtttaaccaagaatggagttcgtttccctatattgtaataaatactaaaaatattatcgtgtggatacatagcttattttatttttattatgaattaattacacagactgacataattaacaggattgttcaatgtacaaaatcatttccaatttgtctggtaaaggtaataatttattttttaattacaaatttgttgcagcatttattctaacaggattagcttagataagaaaaatagttatgatattgatgaatttttgaaaattaatcagctataattatagctaaatatcaatattttatatctttgcaatcaaaccaattgatgatactatgaatacaaaagaaaagcaagacctcattgagttattagttaaagttgtaacaagagcttttggccccgaagtaaccccttatgaaaaagagagaatttgggttgggtgccaaacatacgtttccacatgtccgcaagttttttttgaatcttgccgacatggaattcctcaatatcatattgataaagcgttagaattatctcagaaaatgattgataaccctaaaatggctggaaatataatagaattttagcgttggtccatataggctagtccaacaaggtcccaaaccttatctgctagatatacttctattagccttacttcatttgctatattcgcatcattaagggggtatttccccttacatgattgttttgcacgtaacctttccagaacatccatatcaacagttaccttgaaaagtttaggagcttttttattctcttcttctatttggggaataatttcagtaataaagtcaaaagatgtcttctgatcatccaatatgaactctaccaaacggtctgtgttatgtagggcatatctactttttaatgccaagaataattttgcatttttaggttcttccatattctttattgttttctatagaatagaaaaaaagaagaaagacggttatgaaaaaggtattgaaatcagaaataatatgccagttcttattgccagacaattatcttttagatctaaaaaacgatatacccaaagcataaataacgacaccaattaccccaatagctaagaaaaacttatatagcaattcataatgttcgttatacatatagtccaataaaatggcactgcctgctcctactataataactatcgcactatttccttttgacaaccgtttttggggattctctaataacccaaatggaaacattagtaccaacattataataatccaaataataacacaaatgaacgcaaccatagcaattattatttttctattttaactgtatagcccaaaacatctactattttaagcattgtgtctatactaataattgattttttagattcaattttaactattgtagaatacacaaaaccagttttttcggccaaagctctctgtgaaatttctttttctttacgaattaatgctaatatacctcctaattcttgtgcatcatttgtacgatatgaatgttggccgttctcaattacaagaatatgctgtagtgctttaatatacgacatcatattccccatttcaaaattgctacttcctttttctaaacgatatatagcagtaggcataacccccatttgaaaacaaatatctttcattttaatggtagattgctttcgtatatctacaattatttggcaaaattcttgtctattcatattcttataattaatactacaacaaaaataagcaatgcatttgatatacacaaataatacttattttttccttattattttctcttccacaaacccaacgacctcatctatcttgcttatacagtcctccatcaagccgatatagtcctgcatcttttctcctctggaagacatttgtaagccatctgggagagaatcgtaagagtcttgttcttcatttaagatgtcctccacttctcccttcgcttcttccagggaactaataacatcgttgaatctacctttcctttctttgttcatttatttaaatacgattatattcgattatacacattattattaaatttgtagccaactatgataatgaatatcatgttggctactattatttgaaataaatatttttaatcatgtacaaaacacctaataaatattacgaagacaaccacaaagaaaacagtaaactgtctttcaaagcttttcagaaaagatcagaattttggcagggtgtactcgtaaccagcgcaagcctatacgggatattagtttccctccatgataattttcaagaaccgctatgtacccgcgtggtatttctttgtctgatagtcgtgttgaccattggtgtgagtacagctggcgtaactctatacaactacgcaattcttcttgaacgtcataggcaagaggtcgagaaggaattattatctgcattgaataaagatgctctggtgtcggaggtacataccggtttatcaaagaaggaggagtttgtagaatggttggctctgtttgcattgctaagtacaccttttctattactcgcatacaccatcctaaaaatgtacgtgaattaaccttgcccctatctttccataaaggcatcctccagtaatattcttccggaaacttgcagaatggatgatagtatggatcatccataagagtaaaaggcattcttctcatagcaaaaattctttgctaaaatacccctttgagataagccacttaatcatagacacacaactatcaaaagggctgttctcgatatgggtaccggcaaaacaatctacggtatatctacatacggagaagttatatccagcctcatatttaatcaattctggatggtgaagaacatttggtcggtcgcaaggaatctcataaggaagcagttcaagtaaccgaaccaagctccatgctggaatgtcattgctgtctatgttttccagtgatggcggacacaattgtagttcccattccaatgaatcagtttttgattttgtacagcgatataccaaatctgctgtttcaggttttacacctaactctattaattgttgcgactgctctatgcttgttgcaacttgtgttataaactgtgccatatcgttattattttttcattagttcttcttcaaattcggcaatgatacagtctgcatcaccaccatgtacccaattctctaaaacagaagccagaatttctatagctcttttcttggcatcttcttcaccttgtttgtaggcatccatacctattcgatctatgtctcctaaaaaatcataactcatactttctccttctttactaattcaacttctgtcgactcttcatcttcccattttacttcgggaaatcgggaaggatcaagctttatccaattacggaaataatcttccgatagccaagtattcaatccatcatcctttacgggtcgtgttagaaaaaggtacaaatcaccgtctttgtctcttgctacatacataatcagtagattttagttgttctttcaattcttcaatcatccgttcaaggcgattgtattcatctctcccagctttataagactggtcaatacaatcacgacagaattccagacgtttaatttgttgttccaatgtttcgttcatatctcttattattatattttatactagaggacaatcactgggaatatcaacttcatcactttcgtagggtcgaagcgcagcggctactgtcctttttaatttttcacaaaagagttttacgtcatcgtcacaaaaccaatcatacggttctgggtctggaagaattgtacaatgcggacattgtgtacatttctcgatttcattaactattgttttacccatattgtatatcaactttaattaaaccaatgttttcaatattccaatcgcttttgctatactcaaaacttccttctttgtttttacggaagctggaataattgtcccatttgcagacttagaataggtcttgccacgacataattcataatcgtaacccattacttgtttcttacgagagaaacctatacatccatattgcagcgtccattcagaaccacctccaaacggcatatagttacctttatcatcataccacgaattttgatgacgtcttgcatgaaaataacgagtaccaggttgattatacaataacacctcgtatgcactattgattgaacgattatgtaaattcaatcgttcgcaattcaatcgttgttgggtttcaatcggtaaatcgcagaacttcataatcatgtgtattacgcatagctttcgctttgccagtttatgctcttgttattcatcaatagcctctctcaaccttctcgtcaatgagctttcagtagttacttttatcccatccaatccagtagaattactaagggtattataacactctctaagcaatcctttggaatacagtttcccacacgtatagccctctgttcttacaagctccagcaatttatccaagtcttccatttcccaatcctcgttatcaaggattttttcatatagtttttctacctcgtccataatttagtttacatttatcttatattaataagttaaatttccatctttactaatagtaatcaccccgctcgttaccccaacaaaataatactcggcctttgagatgatgcctttgtttttctccaacatgtgttctgcttctattttatcaaaagcggtaactaagcaaagtgtattatcaatgcatagtctaaaaataaatgtacccatatttattactatctttttattagttaattttcacccaaatacgagaaccgggtaaatctgacttagctgacataacatgaaatgctaatacttttttcacatctacgcggttccctttgattgttcttttaactttttcagcactcacaaaataagtgtattcacgttcaccatttagatgttttttaagagcttcttttgcgtcagattcttctttaaaaacatcataagaatatgcgttataggtccgttctccatccaatttaaattgtagctgataaaagacttcatttgtctcttcatcaaaagattttcctattcttatcttcatttctatcttgttatggttcaacttcaaccccgttttccttaaaaatttgaataaattctcttttggtgatttcgaccacatcggagtctataggactctgactatcatccaaacgaataagaataacatctccggatatttcaagaaacggaacacttttcgttcctgtatcgttagatattccaagcatctcccatatgcgataaaagctaaaccttttaaggttttcaagttcaagtgccattgccttgccagctttcgtctttttatttggaatatagtactctgggttacctctatcctgtctccatatattccgatctatttcctctaaattttcaaacttgaaaccgaaatatgcaggaattctgccatagctgttatctctccatccaaagtattgctcccatttgtacgggatgagttctttcaactttttactgttttcttctttggcaattagttccttggttcgctgttcgtgcaagactttatagattttacttcctttattagttatcttgtaatacatgaatattcctttctttatttatttgagtgttggtttttcgattgtaatattaggcggaagagagttgaccttattagcaattctacaattccattcttgttctacatttgatatagcttccattatcttaccgaaaaggcgaactggaatatcatcgcaacaagggtccataaaagacacacaccctttttcatctattttataccgtattaaaagctgcttacggtcatctacttttttcttcttactcataactatatgtttataagttatttaaaaattccgaacaaccacttttttagatcttttcctttttctcttttctctgtaaatggagcttgaccttttctggatcaaactcatagttttcgcattgacggcaatttctcataacgagaagtagcgggaataataacccgtgcttacaaccccttccgtattcgtctgatgcagatttacaagtatcacatctgtagatgtcttgtacgcaagttaccttcatattaagataagaacatataaccctttttgatagcaaaagcttcttctttactatcaaacattaaagttgtttcacactcacttccatagcataaagctctcactttcagccaccaatgataatttccactaccataatcatcataatatggctcaccgataatctcggttacataatgttcaagtacattcatttatcctccttgttttttgttttgatttcctctaatttgcaacaattatgtttatcatcttgcttccaacatggaagccctgaacctgaatataagtcgcaatagtcacaaccgtcccaatttgggcgtgctctacatacattgataatattttccctttgtttgtgagaaagaaaatagcttcttaatctttccgcattattaacattagttgccatgttctcaaaatttatcatttatagactctcttatcttcttgtcggtgccggtttagttttaaacatatacaaatccttaccatcattatcaagaagataataatccggttttactaatgtaatccaataatctataggcagcaaacgttcgtctccaaaagaaggagatgcgtattgacaagttggaacataatgagcttgaaacaaaaccttatcattgttatatgttgacacgattcttgttatatctgtgtctgaaaagtgttccaagaccccatgtgttaccactactgtagatgattcaaaaaacttaggttcacaaatattctctttaacataaaacaatgggacttttcctaagtaattatccgtagatattgagagtgtgttcttgtaacatagctccaacataggaatattgatgtccgagaagataacttttgaaattttctttgtatcagaaacacctgtcaatccaaaagaattaaacaacctctctcctatttgcgaaatagcaaggcttacagtacctattccacatccttcctcttttaagataaggggagctttcaggtcgtaggatatttgttgtatattgataattatttcttctataaaacggttgtattttttacaaaacacattcacataactgtcgttacagacacgactttgatagaaattatcccaggtattcacagattctgtaatattatctttgctcatatctccttttgattttcaaattacttctcatcaacatacacctctttcttgttgttaggccaagatttacgaatcagggaagtgatcttctttctttgaagtctctcgatagcttttcttttggcttcggctttattattagccgaaactactatttcaaaagcatccagatcaatcgtcactcgatattttctcattacatattctgtttttaattataaatattatgggcatagcaatacctataaccgataaagctatatgtaaataaagaatattgctacagcctatgaatttggatatataataccaccacttaattggtaacaataactgaaaaacaattataatccaagctattacaatatacttcttacctttcatttctttgaatattttcatcatagttatgctttttctaaatcgttattggtagccacaccttttaaaacagttcctccaacttcaacgcgataaaagtaagaaggctgaacattgttatctgaatcttcagaaaatgatggatacactttctttactcgaccaattttaccaaccattgccggttgcaaatcattagagacaattttcacattatccccaacattaaatttcaaattttccatattattgttgttgaattatgcaaccttacgttgcgttgttactaatattttacataatgcctcacaaagaactcgtgccatattaacttctacggcatttcctatatactttttctgttcggcttttgttcctattagcatataatcttctggaaatcccataatacgtttcaactccggaatcgttagcattctcatttttatgtcggaaattccatacatagccatgaattcctttattttcttcattacatcactatctgtgtcatatatctcatataccagtcctcctggaaacatcttaataaagctaggtagatctccctctctagatgcttcaattaaatatggtggcatcttatccattctagcaattaacgtaaaacaaggtttatctactgatccaccagcagaattgaattgagggttcatcaagtaatgccatttacggtttgcagtaattactggtgccggttgatttatacttgtgccaacattcttaaaatttgtatctaaaatccaaggtttacagcttacaagactatatttgggattaacagtaatacagcctagtggtttatccagcgaagaaggcttactgtttccgtattgttggtcaataaacacagaagaaattaatgaaaatcggtcttttgttgttactgttggtgctggttcatctatagatttacaaaatccatttccataatgaacagaaataaacgcttttccggttaggatatttaaacggtttatgcaagcaaccccaagtcgattttgagtagatattactggacatggatcctcaactcccggagcattgtactttccagctttactcattgagttatacttaaccatgaaggcatctttcccacctgctacaaacttaataagtcctgcataaattcttaataaagaagaatctactaaaggtgttttccgaccaaaaatactttttccttcatcatcaaagtctaacacttctcgtactgccttccagttctttaatttttggtctggctttttagaatgggtttgctctggaaaaacaataggtaaactccctttcgcaaatattccgaaaaatctcttcctagaagtgtaagctccatagtctgctgaatttaatattttatgctcaaatttgtagccataagaccttacgttatccagccatctcaaataagatttacctttatcacgactaataggtttaccgtactcatccaaatctccccatgacataaactcttctacattctcaatttgaatatagtctgggttaatagcctcaatataccgaaacaagtgctctgcaagtgttctactatctgcatctcgtggttgaccacccttagccttcgagaagtttgtacattccaacgaagcccataaaactatcaatgcttcaggatattcagctctacatttttgtaggtgggaaactaaaggtgataaatttagtgtacgaatatcttctgtaaaatgaagagcgtccggatgattagcagcatgacttgcaatcgcatttttatcatgatttacacacgctattaccttagcgcattgttcattctctaaacgggctttttctacccctgtgctggttccaccggcaccacaaaataaatctatataaagtaatttcattgtttttccaagtattctacaatatctttatcaggcatattaaaggtctcttcatccagatagaaataaatctgttcatctacagattctgcttctcgtgtactccaattacccatatcatctaataattgtcgcgctaatctctcgacagatacagtcaccttttcttcatcaggagtgttttctaagattactactgtttttattggataatcagcaccattccaatcaatataatctggattttggcaaaacattccacgaataatcgaccatattttttctgactgaaaatcagaattttgtatatgccagtaacattcccagtatgtaaatccggcactgcgtagcatttcctgaataactgtatcagaggcaccattacttactgcatcttgaagtgcacaccagtacccttgattgaagtcagtcaatttgggagttaattcgctggcctttacttttacgttcccttttttatcagaaaaaattagagaaactaatgtgtcattttcaaccggatgatgagcagaggtgcacacttgcataactttctgctcatcactatttgtagggttccacattacttcagcaccaatatttataaaatagtatttattcatattcaattttatatatcaagacatacttagcatactgtcaaagaatattttgccacccataccatatcaaatatgggtggcgataatattaaatagtcaaggtcttagtcaattcgcctttataaccacgttcacgcaacatgtttataagagcttcgtcactatgcagacaatcgttactttttgcctcgcctgtcaacaggctcggcgaaggctgaaatgctgcaaccgctcttaccatgccactgccgtacttgctgccgttgctgaagccgccattactaaagttcacgtaccagctgccgtcctgactgagctcactgctactccaaacccaggtttcatcagaatcttctgtaggaagtaaacattcatcgggacatccaatttctttcattgctttgtttatctcatcacgatatgcgcaaagaactcctagctccatcaaacaaggcaaataccactggaagccacctttttgatagttccaacaacgtttggcagcagtcattccgtcaataccagcctgtccttctataatacgtctggttaggtccaaaccggagaaagtttgcatggcaacggattcattctgttcttcagtcaagaccctatcggtgtttccccatcgttcttgccaagtgtcaaacgccaaaatacggctcataaattctgttgttacgataatgccaatagcattagtataattcatacctcttgctctgaaatctgcgatttcatactgtttcttgtcggctcctaaaaccgaaataaaatacttttccatacttgtaaattattattaaatattgattttagaaccacaccaatagtcttggagtcttccaataaaaattgaatattgggaatatctctttaagtgtggtagttatttttcctgtaatatttttcacatgtctaattcgcaaatgattagctgttacgagatagtctattcctggttgtaatcctatttgcgaaagaagcgatttcaagaatatttttatatgttgctttgcatcagtaattgaacgatagccaaaatcaatgttagctacatacttgatacgcttgcgtttcatttatttttcagcttgttattaaacttgatctttccatttttatataaatcaattttcttttttcgatacttccgttttaactctgtccaatattctgttggatattgtttagagtgtttgcgaacaggaggagatagtatagattgtataagccgcttgctaacattgaacatagcggccagtcttctttggctatatccttcacgggccaaaatctgaatagcctggcgctgttctggtgacaacttagcacgaccatcaaatttggttcctgccaacttgatattctcaattctcaatggcatatttgttactgttttaatgtgaatagattttatagttttatatggtgtgaatagttgtccactttaaccattgtttaacacaaaaggctgctctattttgttagaacagcctttgctttacagacatcactttaactatggtcgattgtaccttagtccgtctgtatgaataaaccatttcttcaaacttccgtccgacttctgaactttctcaatatccactgttaaccaatgaatagccccctcacctaacttgatttcccttttggttgggtgtctccaataatcaatcgtctttttatgtcccatattaatcatcgtttattgccactgatttcaccttgtccgtaacaggcatgtattccatgacaatttatgacctacaaacacaaatatattcctcagcaatcttatattcttcataccgtccatcccaagaattaagtaccgagcaccaaccatcctcacttatgattgaatccaaccaatcactcaacgaatcagtagttccttgagccgccacagattcacgccataaatacgcgtattcatcatcattatgtactctatcactagctatattagtcagttcatcttctgtaccaatataataatcaataccatttgcacagtatagttgttcaccataggaacattcttcaaatgtatcattcaaatcaccgaatgtacatcctaaatgtactcccagagctacaaatcgtttggcttcatcttcgtcacattcacgtaaatccattacttgctggatgatttcttttgtggcaataaacccttctttacccatgtcaaaaaccgcttccagttcttctgttaacgcagtttcttcttcttcaacaaggtcacaaatattatttatgatctcttcaatattatctggaagcggactgtataaccaaccattaccatatttatatccattatctacatataaaccttttatagcaagaaagaaacattttacgttgtagtctgaagatgtatggaagtatttgtttgacaatccaaggatatattgaatgggattattcctcattttctcataaagcacatttctcacctgtattatagccacgtcactaatattaaaattcttaacaagaatctgaaaagaaatatcatcaaactgttcacggtaatgctcattatatgttttaaacaactccacaaagtaattgtagtcgttaacatattgctcgccatttaaatattcatcttgacgaattgtaccgccagacataccacctagatgatatttgctccaaaattccagaagtttcttttgtccttctgtacgaggaattatatgatcgtagcattgcccggcactcatacctccagccccacataccgaaacactgaaactttgtttaaatttttgcaatgtttcacggtttatacgagtagattcttccttataaacctcaaaatctacagtccaactgtttttattttcgtcccgaaattggacggaacgtttgaatattatatcgtttctcataatcaatctttctaattttattttcataaaccagaggaaatgtacctaaactagtttatgaaaactgccttgattaagttatttacgccattccttcattttagcaaccacatcaatgttgttgtcatccagcattttcttcaacataccaatcaaacgccaaccttctctattctcatacaactttgccttcttattcaaaaaggcaagggacgcgtttttacctaatgtttttccattgtcatctatgataacgcaattatgaaaacgaatcatgttctgcattgtaaagaacgctccagatcctttgtaagcatctagccatgctgcattttgaggagtatcccaatgcattttgatacgccttttattgaactcctgtaccgaatgccaaagttcataagtgtttccggcatgttgtattttgtgtactgcaaacaacaatggcttaattatttttctatcaaaatcatctacgaatatgttttgaccattgatacgtttatatggtagccctttacactttcttaatttcaactcttcaaatctctttttgagtttctcgatatagtcttttgccatatctaataccactcttttattaaaccatcgatttcgatctctgaaattatcaacatcagcattctgcatcattttgtgctgggcgtacaactcgttatttagcatcttccactgatattcatatcccatactacgaatcacctctgaaactccaatcggtttataagcaccgtgggtatgggtggctatataaattatgcggaacatctgtgccattacccaacgtctgaataattggcgattaggaattgtgccttgaatcacaatagcttggaaaattggatcatcttctttcaagatattaatgacaccatctctttttgaagctataaactccaaaccatctgcactttgcattgcaaaaagctcactaacatcaacaccagctttctttaaagcttcaatacgctccttagctttggtttgattagctgtaagcgtaaactcggtaccacactcaggacattcaaattttaattgtttcataacttattaataatttaatttttagtctgattatttatttctctactgtaatccagtttttgagaattactaaatctctgtctttgttgctttgccaaaaccatttacccattttattagcgtcccaacctatacccaatattatttgacagagaatgtataattccaattcgacttgtgctatatctcgaccaactccaaacaacatgtcttcatcctctaaatctttatcagacaaagccttaaagtattttcggcttttacattcactcattgttgatggaatagaatgtttatatcgagtatataaatgctctacattagacagaaactcatcaagagaagcgcataattccacacctaagtctccctcatactgcgaattctgtataatatattggccattaagtttgaaacttcgtgttttaaaatctactttaaacttggttcccttctctacagcctgtattgattcttgataaatatttttcataatgtttacttttgattttatactcaaacctttgacacatttctttaaaagtctgatactaacatccagaatacgccggaatataggtttataaaaccgtagatgccggcgtaattgtcggatagttgttaaacgcaaggttcttgtataaatgaaagttgtgttacttataaaacagcccccatttagcgtgacacatgtctatatgcttatgatatatactgtatcaagtaagatacccgcgtaatcctaggtcatacataggatgaccgtcatcacgcggacatcatatcttgtccagtatgttaaattactaaatctcagactgtaaactttgtgttaagtaataagttgtaattctcaaaatattggcacatttctatacttattcgatttagagctggtgtgatcaggaacggactaggacaattagtactcggtccttcctgatatataaccagctatataaatgatatttcttgaattacatatctgtgctaaatagttatcctcataatactgatacattactttacccaatagatgtattccggttggatattcctggagcagatgagttatcgactcatagatccaggaagctgctcaccggaacagtaaacaaatgtattccttgaataacttcgaatgtatttcgcttattttacaagtcctcaaatgaatggcacatcactttactctcatgataattataaatatgacctgatcgagaacctgaggtgagaggctatgcagccttgtaacctccggtgaacgatcaatagttcatactttagaatatgaaattttcttcttgaacttgcctgctgtgctgctttataaaccctcataacaatcgacacatttctttatcttcattgatataatccagattattatatggtacccggagtagatactgaaggatgtaatccttcaaggatagaatcggggtacctaatatatagtctggatattaaacacttgttccttggatttatttactgtgtgttcagattgtagttacaatattgccactaaagtattgtacgctgctcttctggtcaaaatagcattctgcatacaacctattgtcaaataaccttcaatttctttacttttagatttatttcgattagcctttacgttccgaccaatgcctctaacaacgcaaccatccggcttatccttaacatagccaaggccaccaactttatgtttcccagtttcaacggctctaaggcaatccattacgaatttattcaattcattaatatcaacccgaacattacatactggaagggtctgagtcgcccaactatattctccattgcctttatataaatatcggttaaccgaatccacagccttcttcaacgtaataccacgttttctgatggttcttgattctatttctttctggaaggttttaagacgattgggagagaaagaaatcatacttcccttaatgctgaaacctagaaatttaaaccacttgtccatagtcaggtactctactttcttgggattcaaattcattgatttttcggccaatctcttttgtaaaatggtcatagccttttcatagtccggaccaacgaacaacatatcatccgaataccttacgtaaaacccattcaattgggacagttcatcatctaggctatatagcaacacgttggctaaccagcttgctactgcgcatccttgtttaagtgattgatatttctcatgcagttcgttgttctcatcgaaatacaatccgcaatgatagtattttcttaatacatcaattaacacagaatgaccacacttagcttccactttatcaaaggctgcgtcaataaactgaataggaacagagtcgaaatatttacttaaatcagacttccagcccacataaccatcacttttcatgttaacaattgtgtgacttacttccaaaaccactttaccacaaccaataccaacctgataagatttacaagcaggatgaatcatctctggcattaaatcaaatagcaaatcattcgcgatgcttaggattatacgatcaataggttcgttgacatatacagtacgaaactctccgttatccttcggaatttgtgcaatatgtggtggtgttatttgatatttaccattcaacatagcttctgccatgcgaattctggttggttcttctgtcagtttaataagttcgctcttccgaatatccttcagaacgcctttctcaattgcttttgtccatctatcaatgtcgaagaacatcgtaagaatcttatctttcattttatatctcctttctttttgagttgttccttgtatctcctgtgctcacgaattattgctgcccattctgcttttgtaggtttgtatcgcccttctgctttacgttgttttaaactctctttatttttcaaatatttgtctgggctacaaataaattgaataagacgcttgctcactccaaatattttagcaagtttagagtaactgattaatcgcttttctctcaaccattttatatattctttttggtctggagtgagctttattcgtctatcatattgggttccagcgatacgaatcttttctgatttatacggcatcgtttttaggatacattaaatcatcgtgtaaattgttaggacatcgttcatcaaaccaatgccaaacatcaatctttgaggttccggtcgggaagttgagaaagtcttcttcaatctcatcatcgttattgatcgggatgtctccaaacatttcccataattctgaaagggtgcataattctacatgctcttcacaaatattacaccagcaatcttcttcctcaactgaatcattatagctgatttcatctgtatttggatttacccatgctctttcttcaacattattacttccacatttggagcaatacaatgtgtctaatgaccttatccccttctttttaaacactatgtcaaactgtttgagatttgaaagttcgatgagaaccatttctgtaataaaggctctcatcttattaatctgttcatctgatgatattccccatatattagccgcagcttgtactgcattttgcatggaaaaacagatttgagtccaatcatcatactcttttttatcttcgagaatttcatgaattagcttttgggctttctcaatgtactcttggttgaatgattttgatgttttcatataacttcacaattagtttaatttattataccattctgtttcagcagcatttgcttcacgatacagcatatatacaccaccaatagttgagttgtaaataagagtgtatccatccttttgatgtactgaatcagtgccattattcacccaccttggttcttcgctgcaaatatcatcgtcagtccattcatcgctatcccattgcttcagataatcaataacagcttttccattcgcatcggtaaaaacagtcccataccctttaccatcgtacagtttatcacattcgtccagcatgtctccgtactggacatcaatgacaattctataaagcttttgatttcccattgaacttaaatgcggcataactatcttttcttattacgtttacgatctcttcttatttgtttcttattgcgtccatttttagtggacgaacctttatatgtaggaggaacccgtctccacggagtcgatttctcttcatagtcttctattctttcaaaatagaccgtaggtggattttcaaataatatcatattcatttttattctttattgaagtaaaatcgttctatcaaatctctgttcatcaatcaatttaggaacacccgaagttaaatcccaaagccggtattcctcaaacattcgagtttccggatttatctttagtgtcaatttcccaatacttatagtttttcctttttagggaaaaatacatcagcgcctcggatagtaagcccccaacaggttatagcttttgttttcggttcaaacattttatctcctttcttatttatattatctttattattacttttgcagaaaaaatatcatgaaaaacattaattttatatcaactattctcgggcttgtatttcctgtcattggaatcttattaactgttttatataaaagtgataataggataacggtacttttttttattttatttttactttacgaaatacctatactgattaaaagatttctattctataagaaagagagagtaaaccccaatttgaaaaatcttattagaactgagtattcaatgagtattttttctttttgggtttattcgattttaggattactaattgtcgcctttgcaattatctatctattgcatgtttctcttgaaatacactaccctggctttatacaaaggatggttaattcgttagaaaattattaataatattcaacttgtacggatttgagggttaatacttctttccgtgcatcttttcacggagttcgttatacttcattttctgctcgatgtgccaaagcaggtctatatctaagtgcttggcaagcccgaagattgatagtatcatatcattcacggctgtaggaaaatcaaatattccgtcatatctaacaggaagtgtagagatggaatagattgattcggtgaaagtttcgtctttacaggcttctgccatatcttcaatacagtcatcaatatctccgttggcaagttcaaggtttattcctctaagtcctgcaagatcaagcaagcggataacagcatcagctaattcttcttcgattgaacctttaatggtttcgttatatgcaacttcgtaaccgcgctctttgggaatatctgggtctaacccttgacaaatgcgactgttagcaatcttcttattataccaatcaacattggctcgtttaccttttctatcagcttccacagcttccatgagttcggatattataaagcaaagaagatgttcattactcaactcctgattgtgaaacccatgttcgcaagcgattttatatgctttatcccgtaattcgtttaaattcattttattcatatctattctgttttatactattaatattatccttttttctatacgaagtaagttgtgatttgtgtcaggggcaagccatacaagataccattccccttttataaatcctttccacattttaccttcgtatcttcctgtaggtattgaagtcgaatattctttcaaccccttaaacgtttgttcgctcataagtgcatgggtatcgtccaattcaataaatcttctgtgaggttgttgccaatgtttccctaatggatcagtaattggcggtattatctgttctccgttcatttcttgaccacttaaaattaccaaaccctgatgtcatagtctctaaaataatattccagttcttttatcccttccaaactgtgcagtccaccctcgccaactacttcaatatcaacagatatttcatagtctgttttaatatttaccttagaactattgaaagtttttttcacgcattctaaaatgctcgaagaatctgtaccattttttactatattgagtaccattgttttttgaattttaattatgcaacatcatctaacggtccactataaactcttccatccatataatacaacctgtcctcatactggttgttatgtaattcctcccggattgcattttcatcattggcccaatactcatattcttcatgccagcatttgaaaaaactgtcgtagcattgttctattaagtctgtgagcgaaaagttgtccggataactgcaccaagttttataatatttaatgataggttcaagcaagtaataatcgtaacacataccagttagtggacaatcctctaaagatttaataaccctacttcgtctatgcttataagtgtgtttcccgtctatacactcacctgaagttgaataatattggccatgcgtaatgtatggcataatattattattgatatatcggaacagtaacttcccacacaaatcctctgcgtaaatgtcattatcacaattaactggacattcaaaaattgggttataactacatttaaaattaaaatcgtatccgctatagttaacactccaactatatgattgggtgtttgtcaatttctcgaaagctcttagagacgttacataatccgaaccataaccctccatgcactgctccattatattccagcgttcacgctcaataatttccttttgtacctcatccgacaattcatcaaaagtgtacagttgcaatgttattgttttcattgatttaagattgttggttttcaaactccatataaaggaactctgatatatttgactggaaattataggatattccccatgttccaaaagtttcaaagaaccagtcaacaagaaagtcccggtcctcgttagcttgttcgctgtcttcaccggcatctaatctagcgatcatagcatttacaagaggcgtatcgtatgtaacctctccataaatatgataagggtagtcataatcaatgttattgaaattaccacaaatcctgtggtctggattatgcaagtatttcttcatatcagaattaaattgccaagccattacattgctgtaatcttccagatattcatccgaaaagttctccatgataaaatctttattttcatcatcaaccatgctttcacgtgcatctttgagaatttgacaaaggcgtgtcgccatattgtcaatatttatatacttcttttcttccattttactactttatttgaagttgaagattatcattaccataagaatacatcattacagaagctccacaaggagcatttttaccagcatggaaacatctcacacctatttcacgaagtttctgaaaagcatcaaatgattgattttcgtttggaaaatgcaaatcaatagaactaccaatatctacatgctgtacctgcaaggatactttgtttttgtgatttaagactattacatccatattattcatcgttttcttgttcacgtctatattgtctgtatctatcgtatgctttaaatgtctctgctatagtttcagagagatcatcaaattttagaggagtaatttttgcaaaatatgcaatccctttagttgtataacaacaatttgttacaagtctatctggagtgccaaacaaaccacgaactttaaatcggtcatctgatcttacttggaaatgttctgacaacaccttcaatgtttcattaccagctttgactgcttcttccaaagtatcaaatatacctatggcaattgtcttactacaagaagtagctgggcagctacctatcggtctgtcatgataacgaaattctatttctaacaattccttttgcatatttccttttgtttttattatcgaatagttttttgatggtgtccatagttgtccactttttgaatattaactcgctttaactttaaaggaaaaggcgcaaccagaacaataacattctgatcgcgccacccttcaaacaaaaacatgtcgaacaacacacatggaaacaacaaatatatgtagtgttccgggaatcgaacccggatttctaccataacactttactcgtgcttacgatactctttcacttgttcaatatcatccatattgttccaccaatttgaaaagtcatagtaaacaagatcttcatcaaattcttcttccccattttcatctgtagaaatatagtcttctctgtcaaggctggctatattaatcatatcttcggtgtctgtgataccatcaaaccaatcttgcgcttctttcacatcatcttcactaactcctgcatcaaaatgttctccatccttgtatccaagccaggctgcgattgtatcaaagtcaaaccaaaagaaattatttatgtcatcatcggtccaaccactttcaggagcatcactttccattatggattcaattttatccagttgttcatcggtacagttctttgcccggtcctcacccccactccaaaatttgaaatctcgaagtgaaatttctgatataactttcatagttcgtttgcttttaaaagttccttagcaacttttcctactctcaacaagtatttattccataccatcacatcagagattctgttctgaacaacagcactataaccgcatttaatattcaattctctcacatcataaggggaaacaagcatacctccatgttgtgccaagttataatccggttctttaggaaatgattttatatacctcttaataatttgaatactctcttgcctatcctttcctttggataacaattgtttctcaatactattcataacagcattgagattaggatttactgaatacttcatattacaacagttttatgtatgaatactccaacgtctttcagtcgcatttggggacataattatcccgccgcaaattttgcgttcgccatttactacctcagagaatccaaagctatttttcgcaaaatcaccatatatttcaatatgttggttaacggcaaatctcacccatttttgtagacttttcaagcaatcttcaaaacttgaatcttgcaattccgaagcaatattcttgacctcttttacacgctctgatatttctggggacatttttaattccaatggtttgtttatggctgcatactcttcagggtattgaatggaaagttgatgtatccggcttccccaaatattattgaatattgaaataaccttatccttggatactttctgaagctgtgctccatcccaataaaaatacttattatagtccaaatcgtcccaataaacaatacttgcgataatagcatgagaatctttcataattgcaaaccggttactttctgacgaaaaaagactttctacactggggccaataaaacacaaatgtgttccgtgtgtgcgcactaaccaaaaaaatggctcattggtcttttcaagagttttcaaatcatacttctcgaaatcagagatgcacaatttagtatcgtataactctttgcgcatttgttcaataatttctggtatcatacttctttattttaattttcactttttatcaatcttccagtataaccacggtattcaagcaatgtcacaataagatgatctggcacatctctcaaacgtctgtaattttccgttaacacttcaagcagatattcctcatcttgtccctgcaaaaaattagtcaactcccagccataacttgtgtacatacctatatatttactactttggaataacgtaattctccagtgtatccacgtctacgcaattcagcaaacaacatgttgtcatcaaagtcagacattttcagagtagcttttactccttgttgagttatgccgccactagatttgcgtcttctttccttgtcacacttcttacaatagtttgccaacccatctttggttgccttattcttagaaaaatttgatataggtaagctctgaccacattctttacacacttttgtttccattattatcttgatattaattgttctcttcgggatggagtttcaaatactcggtaagttcacagtcatatatttgttcctgaacaatttcagaaacaagggaatctcctttagtctcccagaatttcaccaacaaatcaatattggcacattcgggatgctctgtaattatgcgttctcggatttctttgggaatactatcaactacatcacacacataattcaagtggcaggcttttaatgttagtacaacaataacgcatcccacgattattttgaatatctttttcatttgatacgttttttaccgctgtacatttccagtgcacgctctacaagtaagttctgattcctgtcatccaaattggcaaaaaattcttctaccgctccataatgaccattttgactattatattcacgatacttattccataaatgtctccatccacattcggctttttcaaaagcaacagcacattcgtgctcatcccagcaattccacatatagtagaagaaactggctatatcattcttttttgccattatctttcacatcaatcattataaatttgaaatatttccaactctccaatacaatactatattgcttctcatcctctagttggtacatggtaccatctttcaatgttaggaagtaagtgtttccatctatcctcacagtcttctccacgcgctgtatgtttcctgtaaatacccttatagtcttggcatttatcgcaatacaggaaaacaacaggcatataactaccaagattctataaaatttactaccaattgcagtagctactttgatatactttttccgcttatatactacaacatacttcttcatagatttacgctttaaataaatcatacacagttttccgtttcacggtaacattttgagatttaggcaaatagaatgtcatacttgcacaagaggtagaaataacttttacgctcgttctttggattcttgctcgtttcatgctttatattttaaaggtttacaatcagacacaaaaatggcacgcactcaaaagtacatgccacaattaaagtgggtaacaaagactcgcacttcttgcacactacgcttccacgttcgttttacccatagaaatagcacgcctgtattcacctccagacgtgctatatatgttatgacttaccagtttttatttatgcagccattcgcgcatcatattccgcacgcttttgagcatttcccagaacttcccatgctgcatttacctcttgcatcttttcattggaaccaccggcatcaggatgagcagatttagcagcttgtttgtatgcagctttaatttccgcttccgtagcatcatgcttcacacccaagatttcataatagtcagcagcttttgcagctacttcttcaaagttcaaacggaatttcagagcatcgaaagacgcttttgtagcagcatggattttcttcttaaaatcacgcgctgcacaatccaggtctttctttgtaggcaccaaaccaatacggctccatacacttccctcaacatcccacttctttgacactttgcaatcacttgtacgcactatgatttcagccggtgtaccgctacgcaatttggatgcaataccaccattatcctcacgcagcccagcttccaccgctttcacagtccagaacgtagctaccacattcttccacacgcggaaaatctcgtcctgtgtcttatcctttggcgtgtattcatcaccggcaaaattcagtcctgaataatgcgtttctccgtcacggtttacactcttatacaccaaagttacgcctaccaactcatttgcatttaagttctcaaattgtacactgttatacctactaattgttcccatgattactgtttttttaggaattttctgcaatagcgcattgtaggcaatcggggaatcgaaccccgacctaccaaaataggaacgcaccaccgaaaacgtttacacgctttcgattgcgttaaagcccaatcagagcatactggacattcacctatccagcacactctatgtacaactttttgcccgtcactaacagcgcaacggagccgtgcgccctgtgtatgagtgctcaccaactgcaaccaaaccgattgaattgcagctttttacatacgctttcgcctatgtggtaggtaatttccatcgttaccgttaaagcacacttttggcatacacttcttcactgttagggctgcgttgcgttggtgattacggtggtgcaacttgggcacactttcgacagagtcagttttacgttttcacgcacttttggctcaccttttctcagttcgcatcaggggcagattttcacacctttgcgcagacatccgtttttcggtatgcaagtgtgacaggcacacttatggcactaagcccacgcttttccctttttcctcacgtccatactggcgagggtataatttatgcacattctaggcatactacgcgcttgttacgtacaacttgctaaactcataacgctatcacagcggttgcgtagttttaacgtatggacacacctggggctaacgacggtttgcataaccctctttaataactgagcattacagtcaggtgcattctttccccgttcacaaaacatcccgtttcatgtctgggcgtgcgcttttgctttcgctttcgcactccttttgcttttatgtattactttcttttgtccgtttcttacttcttgtttttacggttattaattacgtttattatctcgtatctgtttgcggttttcgctttttgtaggtttacaggtaaaaaccaaaacggaaagtaaacactttatcaagtagccgttatcttaacttgacgttgcaaagatataacgcttatttgatatacacaaataaaactgcaaaaactttcattttaagactaaaataatttgtaaacaattgattttcagcaatatataaatatacaacaaagaataccgtatataaacaattgataatcaatgaaataagcaccccaacacacgcgcgtgtatgcgtggttacttattagggcaaatcgtgacacacatacacacatgcgcacacatatacgcgcgggatgttgttacctggatgcaaaaaaggaacgggaacaaatcacatacacaaaaggataaatttgtaattatttcaaaagagtatcaaaagcaaaagaataggcaaaacaaaggacaaaagtacatttgtttcacttttgtatattagtgaaacaatataatcagctgatttacagaaatataacagcaaaaatatgaaaaaaaagaaggcaaagccggtcaattttggagcggataccgtatatataatccgacctgatttttcaatctcgttttttcaaaagtcgatcatagtataaaaagccaattctcttccagaccacgttattcaatacaataaaattatctccaatttctaacattaagtttataatatatcgaatctggaagtagagattttgtaattatcccagcatcaatttattaactttatttttctaatacagagaaataattatttcccaatatattcaaattgacaacgatataaaaattcaatatataagttttctgattttttccagccacctattttttcagtctcgttttatggtaattaagctaaatttttatatccaaattgacgtttatcaaaaaatcatattacatttgcctaacaattgattattttatccaaatatgaaaactaaaaaacaagtagagcattttctaagaaaaagaaaatataagtctgaaattgattttaaaggaatcagttcttattgcaaaacagaatataatattaagttgcatgtaccttccagttattcagacgatcctgaatctctcgattacgctacatttgctaactggtttgacaaaggatttggagctggagatgcagtaaaatggaatgattctataggcttggtacaagaagggaatgtgaatacagttttaatatgccttagaattgacggaaatacgcctaatttcgacaaaataacaatccctgtagacattataaccccagccggagaaaatgctttaaatcgcctctatttagttttagatgaaaatggtcaagaatttggcaacccatttttcgtaatttctactaagtatattcccaaatcatgtgatttagtatgtttccataaccataaaactggtcaagaaggatatggagtcgtaagacttacagataaatcctctggagacattgttatgtattgctatgttatcaaaggggaaccggttaaatacagcatgaacgagtatctaggaaaaatagatgatttctcattcacaactttcaagccagcggactatcaaagaaaggctctggatatagaattagctaaggtcggtaagacatggaatcattttctaaaacgaattgagcctttgaacatgaaagtagctacaggagaacgctactggtatattacagataaaatgcaagttacttctgatgtggaaaagggaaatgtaacaagtaataaacgttatctggcaggcaattatttccggaaagagaaagatgcgattagaatactgtctgaagaaatagaaattagaagaaacttcttagccgaacccgaaataagataatcaagcccggctaaggaaaaagattctggaaggtggcaaaagacttcatggttgttctgccatctttttgttataaagatcttccacatcacttgcctgatttacctgcacgttatagtttataatcttatcgactgataactgttgaggatgaagtttaactgtatttttttgaggaagttctttccacaggattcttaaatcttccacaggtaccttcgattcgttcgagaaacgtttaagcaaatcttcataagctgcttttgtcacttccgatggacgaggttgctgattactctcccgttctttcacgaactcaatcataagccatattgcatattcggcatctgttaacatgttcgtatctttttcggcgatttgccgaatagattcaagaaatattaatctggaggttcggtcccctactcctttccgtttaatttttctggaagatgaaggagattgattgatgtttttaattttactgggagtcacataacatacaggctctccattctgcatctcaacatcgaatccaaaaatattcttcatgtcttgttccgaaagagagaaatccggattgatagtttttaaatcattccaagcacggtaaagaatatctttgaaatattcagctgggatgtaattacctggagagtcttcatcatattgcaaatatccccaaacttctcttattgccatatcaaaatcattatcggcaaaatctggaaggttaatgatagtttcaaaatcagaagaagaaagatctggaaaggataagtcacgagaattgaaccattccaaaatcttcatatcagtttctttattaaactcacttcgttcgttatgattctctttattctctatattatctatatatatcttattctgttgttcaatatgagcggaccctcgttcaatatgaacacacccctgctcatattgagcgcaccctcgttcatattgagcggacccctgttcatattgaacgaggttagattgctctttgactatattttctgatagtttttctatgtctttacctttttcttcgtctatttgcgagggtgtgttcatattgagcgagggtgtgttcatattgagcgagggtgtgttcatattgagcgagggtgtgttcatattgagcgaagtgtgtggatattgacgaactacatcgttcaatatggtcaatggaatcgctgaaattggacgtacctcgctatttaagcacaagcctcgcaaatatacccatcctttatctgatatttgagaacttactttatgtattgctcgtatctcgctccaatttacatagaatgtgcaaagtgcccctttattttgagaacagctgataagattaagttgcttcaaggtatctattgcccggcgtactgaactaatagaagttcccatgacgtcagctagttctttgttggatatggcgcatgttgtcttatccccatctgtatagcctcttcgtaacagatgaaataaaatcataaagccatcactggatgttaacgttgccattgcgtatggaatgcacttccagtggttatcgaatttgtcggaaaacgtactcatttgcttatatcatcttttatataaaaactaataatctgccctttaaccatctgtttggtaagacggaaacctatttgttttgcaaatcgtcctatgcgttgattattgggtgcatacggaaatctttcagcataacatgctctcatatcttctacagaaactctgtttttattttctatatccatacttttattaaattagttcgttatacatcaatttattatttctcttcgttttgacttggcatattattttgttggcacaagttaagttgattttggctcatcaattcatcgcatgtccgtttaaaaggacaatctttacaggctgtattctgtgcaaccacaatggttatagccgcgattgagacaagcgacaatgcaataattaaaagaataacaatcattttatttcaagttttttgtcattaatataaagtcatattttaatgggtcctctgcatcccaatgacggtaaacatgagtgagttccataacagccttccagctttctttaggataagatataagccccatacgttgtgcttgctgcgcaacatgggtatccataatagcgtatagttttttaggtttgattaagccagtctgccatactcctaaatctatttcatctttacgaaccatccaacgcaatagcatattaatacgtttacaggcagagttacgatatgggcttccaagacgggctggttcacaccaattacataacgtgagtaataaatcatcaagtgaaatgggatgtttttttaaatattcctgaatagaatcgtgtttactgtagaagtatcttaattgatgacacacctctttaaatatttttcctgtaagagtacggtaaatactatattcgtccggaatatcataaaaatcaccaaatttaatatacttacctggctcccatccacacacgtccatcaacttctctgcacaatatattatatgactacgttgtccccatgaaaccatagccgttaatattgcacaaacctcaatatccgctgtagttctcccagaaagattccgtagccggtgtactatttgaataggatcatttgagataaacgctttatggtcaaactgattccacattcgttccatctcattttttaatgtatgtatcattattatccgcttttaaattgttacgataaaaagttatcatatcagctataatattagttgctgctttggcttgttgtgccatttcataattttccgattttaccaagttttcattccaacaccatatatcatatctgattttccataaaaccatttcattggcatcattcgtaaattgagagtgagataacattagcttctgaagataatatatctcttgaagagttttgtattgcttagatagtttacgaagtgcataaatagcaatggcaaacaatattaagcatagtataaaaattgcgtatatcatattttcaattcgtttatatttataaatgaaggacagttttcatcgccaatagtatgattggccggaatcttattgaaaggtccatctcgttcgcaagataaattatatctaagacaattatagcgatcccaacatcctttagcatgacacttatgagagtcgttagataatttggtataagttatcaatgataggaaattggcagtatctggcaattgctttctaaaatgttcagggatttcaccttgatgccatatattattggatttgattagtgttccatcaaatcgccgaatataaaattctttgccttcagaacctttaataacgttattgggtcgttttacaaatggatatacaatataataatgagaaccaataacttcattacctatatccggatgagctattttatccatccagaaagcacagttagaacagacatttcgtttactcataatacgcaaaatctcacctggaggattacattcatccaggttctccagcgtattacacaattcacaagtaatgatgatgggtggggatacagacagtcccctcttttgttgtataaacatggtcaattttatttatccaattatggagtaaagataggggcacatgtcgtgcaaatcaaaatgtaaaatgtagcgaagaagttagagacggatagaatcgaatatagaatttatttcatcttctctaatgcagatgtatattttagttatttcaatgttagagtgattgaatatcctgttcaatagtaacagtgcttctgacttattttcgcttgtatcataaacatatcgtccaaatgtttttctaaaagtgtgtgtagaaaaattttctatatccaatttatatttagctttccattctttcattatccgattaagatattgggaagagacagatactcctgtaaatttgcttttaaatattaattcattcggattagggcgtttaagcaatatataaagttcctctattctcgtttgaatacttaaattaaatgggatttttcgtacttttccagttttcttctcaattttggtcaatgaacctttatggagaatatcagcccatgctaaagacaatacatctgatactcgtagtgcagtgcagaatgccagtcgagcatatagttcccataaatattgccgatccttatgaagaaggcgtagtaatttcttatattcttccataggaagataatcacttttggttaactgatttttctttgccataattatatcaattcatttactcaatgcaaaagtatgatattacattcaattatacaaatttagaagcgattaatatcaatttaaattaatattaatcgctaatattttgtaatacaataatttaattatttaaaattccatagaattcttcaattgataaaattggtatccccaataatttggccttggatatttttgatgagttggcagatttgtccttcaccaccagatgtgttgtttttttagacaccccactaacaatttttcctccttcgctggtaattacttcttcaagattactatctcgaaatcccgacatacagatagaccaacctttgcatttaccttccagcacagcggtctttagggacaatctgtaaggtattttagtttcctctaaaaaggccataaatggaaaataccccaacaataagttttgtacagttataggacaatttttaaagtcttcactttgaacatccggttcgtgattgatataccacccttgacagaacgagcataaatcctcatcatccatttcatccaatattttttgggcctttatttttcctattcctttaaagcaatcgctggcttgcattaaagtcgccaaatcaaccccttgcattatttttctgttattctccaatattatctttgaaatactgtctccgaatccttcgatttttatcagatcgttaaaagtaatgttaagaatcgccggtatagaagtaaagcctgcattgaatattttggataatgtttcttctcccatattttcagccccacatgtcaaatagaaaaatataattttagctaattgaacacctggacaactaagattagtgcaacacagttctatgtgattctcattccacatagtcggtgaaccacaatgaggacactctgacatttcatcccataatttttcttgttcttcttgtgttgctggggtaagagttgacagaatcttaggaattacccctccagaacgggtaactaatatttcagccccctttgctatttcgtgatcattaatccagccagcattatatccagtaggattttccatgttgcaatctccagtatcaaccatttcaatattaaccacaggtttaagggcacccgacttactgactttccatacaatatccttaactgttgtctcaaaagattctgtaaaatctggatgtttgtaggcaatagcatataatggatttccagatgtttgatgtctgccaataacttcccataagcgcaaatcatcaatataaatcacaataccgtcaattggatataccttactccactctttgaataaattcatcagtagctcttcgttcagttcatctataaaagcaaaatggtaaagatgctcttgttgatagatattacaaatagtttctatcagactatggaagttgttataatcatgtagggaactctcatccaccccatatctgaagaaagaagcgtgttcaagataatcacatggttcatctctatttaaaagaccggcagctgtgttacgcggtgatttaaaaatatctcctgtgaatttagaacgtttcccatgaaaatgctgctcccaatcacttctattgataacaaattctccaaaagtataatgaaaactgctggcagggttataacattgaatggatgctcgataatggctagtacaatcttgcccttcattttctatccctccacgagaatatgtctcaccagttaattcattatatagtagagaaagaccatccagcttaggcatacatattacacctgcatttcctttcaagcctaaagacatataccattttttaagttctgatatatcctttactttatttaaagatttcattgggattggcaaagcccgttttcgggtttcaggtacaaaagcgggttcggtatgtttgaaccattcattgtctggatcaagtgtttttaatagttctatttctgcatcatactccgcatctgaaatttctggcgtacccatacgatacatattattgtgtcgcttaatcatatcaagcaacacatcttttgtttcaactgtaaaattaagctccatatcctataatatttataaattaaataatggggcacataaaacgtaccccatatttcttattttattcctgaatgcccaaatccttgttcaccgcgttctgtgacctctaaatcttcgattgaagaaacaggctcccattctgcttgttcatatttagagataatcatttgagcaatccgttccccgtcattaacagtaaacggctctgttccatgattaataagaattacacctacatcacctcgatagtcggcatccacgcatcctggagaattaagacaagtgattccttttttaagggccagtccacttctaggctgaattcttgcttcaaaaccttctggaagttgtatatgtaatcctgttggaaccaatacacgttctctaggattaatagtaattggagcatcaatatttgctcttaggtccagtcctgctgattgcttagttgcgtattgaggcaacggatgttttgatgtactataaacttttactttcatacgttctattgtttttattatatttccattttttacggttcatcgccatcgtgggatatgtctgacgttcgataccacataatttgtcatattcctctaacttcaatgaacctatatctgataattctatttcaacatcactgcctatatatctaaaataatacataccattggaaatcaatgtaccgacacaagccttagaaatatttccaggctttaaaccgctgattttagctgcctcatttactgaagcagccataagagccaatgtttttctgcgattaaatattaagacagctttgggtttacgaaaaatcttctctgccatcccaaatttgtttgagcaattctggaggaagccttttctttaccaacgaaattaaatgtgtatctgacacaacaactccagtaacaaacatttcgtctattatttcattgatatatgcgcagaattgcggatcaacataagataaaaacggatagcataaacatccgtcaatcaattgatgcccctccgtgttgattgataccagtttctctaaaggcaacttgtaagtttctgcaatagccttgatttggaaatcaaacttatgaaagaagtcttctatgcttaatttattgtcggggtctttagattggagataatatgtagcatcaaaaattctgctaccatcaaaatgagttccaaaaaggagattaggaaattccgggagtgagacttctgtacatttgatattgataattttcccggttcccttaggagaagtcattataccctaatgttgttttgatgagtttcaggtgtaaccatgaccgattgtgctttgtcatatttgacattgcgaatagtatattcacgtgtttccccagcccgttttaagtaagtgcgaatattttctatcgcttcagatgaagaataagccggtacataaattgtactgttggaacttttggttttaccagtctttttgtccacatcataataaacaagagatacttgatacaacccaacttctgtatcttcactttcttcaaaaaaataggatattaatccacaaattagttcagtatcagtagcaaatgtatcgttataagcaacttctgaaattttggtgcggacaatttctacatccacatcaccaaactcatcttttccttcagccaacttatatgcgatttgttctgcttcggtatagcatgtagccattaccagatcttctgatttgatgggaacaatagcacctagatcatttgtgcccttgtatgccatcttaatgcgaaaataattaaaatctttactcattttaatgacgtattatttgttaaacattaaattatcgacgcaaagatattttattttatcatattgacaatataaaatcatatatttaacacatattttatagctatatatctataatactgatatttacaaatttcaaattataatacatacactcctaccctatcatatatatagaaaccaactttagactcgctatctattctttcaaaaactcttaatatgaatgtaattagtgcagaaacaacatttcacggcactcctttagaaagcatatttaaaactagcaaaaaaactattcaagaatatgttagggagattgaccgtcattgtagatacaaatccattcaatcccaagtaacacgcggggttgttttagatgatcgtggtccactgatagatttatacgaagcatgtgtagagcaggatgctcatttacgtgcagtattagaaactgtagaatcacagattataggcgaacgatacatgttggcaagacaaaatgaacgaggaaaatatattaaggatgtagaagaaaccaaaaagatacaaggttctcaattcactaaaatcataaaaggtattgttgaagccaaatggtacggttacaccttattagaaataatgcctgatattaatcctttaacaggaaagctagctgaagtaaatattattgagcgaagaaatgtgttggcaagtcaattacgagttgtgcaaagacaagggcagtggaatcctggatgggatattgcttcatcgcaatactccaagaattatatacttattgataatggtgatttggggctattctctgcaactactccaactatccttgcaaaaaaattcactcttgctaattatgttaattttagtcatacttatggccagcctatcatacatggtaagactgaatcagaaagcattcaagatcgacaacgattagcacaaaacattgcaaatgcggctcagaataaaataatagttacaggattgaacgatgatattgacattaagacatttacaatgtcaaattccgaacacatatatactagtttaataaattttgccaatacagaagtttctaatctgatagttggctctgaatctatggctggagcaacccaatcttatgttggatcaacaaatgctcaccaagacatttttcgggagcgcatagagatgtatcgcggtttcattgaaaatgtaatgaatgaagagatcgttcctagattagtatctatgggatatatcaagccgggattagaattcaaatatgccaaccgtgtagaaatgagtaataaagacaagattagcttatattcttttattacagataagtatgaagtatcagcagatgaaatcgaaaaagaatttggtattgtcgtagggaaacaatttaacgctatatcggaaatggcaagtaatagcgggagtataaatggaagttccaatgatagacgcattatgtccgatgaagaatattacaaaagatatgggcataggcgtggtgaacgaaagaattcaagcaacgttgaaaattttctaatggaaggagaataaaagatagcacttctccttccgtccttgcagaatctaaatcaaacaaagatgaagagaatgctgaataccttgctatctatgctgttttccagaagtttttacaggactatggcaatatagaggatcgttgggatttattagaagaaatgatgacgttacgtgcggaatttgcatttaatcatgcaatcaaaggttttggtatggactttgaaaaagcactggaattacttcgtaatcacaatgatggattaaccaaattagaaaaagagcaacgtaatatattagtagctgcattagataatcttgttgattttgcagtagctgaagaatttcagatgttggagaaccttccagacaattttaatattgacaatgaagcagatctgacagaaactgaaaatgtttttcacagatacaatagcatatacgcgaatattgaaaacgaagatattgaatatgcgatgggaattgctgctggttggattttgtatagtaataatacagtgttaacatatatgacacagggagataatagggttcgcccttggcatcttgcattagaagggactagctaccgcaaagcatctttcccagcatggttaatccccccaattgaacatggatgccgttgctttctagtggaagaaagtgctgacgttctcaaccaatccaaattatcacaggtgatgggacaaattgttgagatgcccgattttgttaatccagtatttaaagaaagtgtagcaaaaggtgggcgaatatttagtgatgcacattcatactttattattcctaaaaagcataaaaagaggctgcgcaccattgctaataaaattaaggacaaatggctggaaaagtaataactccaagacaattagctcaacaatggttgaggttgcctaataaatttgaagttaatgtattcaattttgaaacattggtaggtaatgccgcaaaaaaaatatttagagactctttttatctccggcggttcaattcagccggaactttttcttggcaatccagacgtgatcataagccacaccctatattggaagaaacaggagcattaaaacattcaatagtatgggaacgctttcattctaataagaatcgtggtgttaaattattcacagatccagatatgttcaaatttagtaataggcaatatggaagaaacttttgttatgcagcaatacataatgaaggagggaaaattgccaaacctggttctccagcatcctatattagacaaaggcaatttataggatattctacaaccgtagctgataaaatttcatcttacagtattcgtatttttgatggctttccaaaatgatagtagataagtataaaacagatttaccggacagtttaaaagacacacttgcaaaagacacctctccccttcccgatgatgacgatactactttggaggaagtagacaacaaccctttagaggatgtgtatttagcagtaaaacgtgtattagagtccttacatacagaccctaacgataataattcgcccaaactattccaaactgtaaaaatagataacggacagtttgaacgtattgttcgtactcgtggtaatacagaatatgctataccttttcctgcggcatttattcggtttgtaaatgtacgttatttagttgcccaacaaagaattggagaagggcgtgccactatgcgcatcagatttgtacttaatgatttaaacaatagtgacgatattattgagacacatggatttcgcgtttttcaacagattaatgatgcaattcaagatgcgaaagattacgaagaagcattaaatgaacgttgtaaccttacctattttgatatgccggaatctttagatcatgggctacagccatactggattgactacgagatatggtttagaacatcttcttctttccagtatcgcaaatgggtagacaggtatttagttatgccaccattcacgaaccattctgatgcaccagaacatgattcagaagcacatggtaatcacaaagaacctaaaatcgaagatgtagcgaagtatgaaccttctgtagaaatgccttcaactgatcctccaaccgatcaagtcgaataacaaacttacaaccattaaagaagctgatacctattcttgtgaaaaagctcaaatgaaagtagatgaattaaaatatgtagttggagaagcgcaagaagcaaaaccggtatatatgcgcttctatggcaaaattgatgaagagagcacacgtaattttaatgatgaatttttatggatacaagattacgttaaaccctcgaaaattgtaatcagcattaatagtgaaggtggaagcgttctgtacggaatgggaacattctccattatacagcaatgtcccattgaagttgaaacaattgtagaaggattggcagcatcaatggcttcagtactgtgggcggcaggaactcgttcttacatgcgtgactattctattttaatgatccacaaccccttcatacgtgacgaaaagtcatgcaacccagacaatgaacaaattgtaaatgcttttcagaaacagattgaaaccatatatcataaaagatttggtctgacgaaagctaaggttcgagaaatcatggatggaaaagaaggttgtgatggaacttactttgatgcaaaatctgccgtaaacgccggtatattatcagcagaatgtgttttaaaaacctctaaacaggtttgtaataaagtaaaagatcaaattgaaggagtagtggaagcgaacgcccttcaaaaaatcatggcttctatcaatacagaactgggcgattttaaaccacttgatgattccagttctattcctaatcaaaatcaaatagaaaattcaaattcacaaaaaacaatggacaaagaacaagaatttgcatttggttctgtatgcgcccagcttggtttggagaaaacctctgaagtttcagctgttattacccgaattgacgcattgaaaaatgcggaaaacaaggtagcagaaattcaggcttcatacaatgctttgaaaattcagaaagaaggattggatgcgcaacttaccaatgttcaaaacgaattgaaaactgtcaagaacgaattgaaaagttacaaagatgctgaagaggcaaaacgtaaagaaactatcgaacagttcgttgacaatgcaattgctgaaggtaaaatcaattctgatgcaaaacctaaatgggtggaaatggctcaaaacgattttgaaatggtgcaggcaacgctgaattccattccaaaacgtgataaaatttctgctgaaattgcaaatgatcctgccaacattgaaaatgcaaaaaatcagatgaccgaggcagaaaagaaaatggctaaggctgttgaagctgtcgtaggaacagatttccagtttaaaacactcgactaaaacagaataacataaacaacatggcaagttcagtaaattttgcgcaaaacacatattctggtgaggtccttaatgacctcctgacatataccgcgcaaggaaatgatacatacaaagaaggtttgattcatatcaaatctggaatccagttcaaatacaccatccccactattcaattgggaaaagtaattcaagataacgttcccactccaaactcgactcatggtgcaggagcaggaaccactggtggactgaaccaatacacattcacagaacgttatctggaaccacaagaattcatggtgtaccttgaatttaaccctcgtgactatgaaaagtattacaaattcgcccaaccggaaggtaatttggtattccgtgacttagacccaaaagtacaggctaaaatgctgcgccttttgatggatcgaaagaatgagtatatcggtgagtctatttggtgctccgcaaaaggtggttcagcagccgcaaaaattaccgctcctgaaggttgtacaacgattggaggtgaaaatgccggtggcccaatgaaatactttgacggtgcaattaaacgtattctggcaaataccgcaacagatgcaacagatgtggaaaaagctggcgggcaagttattattgccggtactacagaattaagcacaggtgccagtgtagaagccgcactcaatgctatgtggaagaaatgcccgaaacaaatccgtaagaaagcagggttggtatttgtgtgtggctgggatatttgggatttatatgaccaatatttgagcgacaagacggtgaaatactcggacaatactaaagtcaacgactatcgcttcaaaggtaagcgtattgtacctattgttggcatcccagagcacactatcgtactcggagaatttactaccggtatggaatctaacctatggatgggggttgactatgcaaatgatgcagaagtagtaaaagttgaacgactgcaagctaacagcgaattgtatttcttccagatgcgaatgaaaatggacgtaaacattgttcgtccggcagagatcgttgcatggacagcatacaagaatacagttgtaagcggtggctaaaaatcaaaagtaatagactattatatcacaagggagtggagtaagtgctccattccctttttaaatttaagttatggctagaaaaaagaatacagaagctccggttacagaagaggttaaaacacaagatcctacagttacttcagaaacaccggttatttcaaatgaagaatctgcaaaacaagagcaagacactgttgaaacttcagatacctcctctatcaaagagtcttctcaaaaacctgaaaaaaaagacaaaacaaaagaaaaagatgaaataccagaattcgtaaaagaactgttacaaaaatatcctggctatccggcattgtatattgattctaaaggtggtgtattcaccgcagatgcacaacctaattgggtgaaggatgctattctttatcaaaatccgtattacaaacaataaaatttacaaatatggcattaggtggcgtttttatgagtgataccgatggaaacattggaacaagctctacaacctcaactgaaaaagtcacaggtttgctgtttgatatttccaaacaagctaaattcttcgaagaaggtgctggtttggccgtaaaagacaaattacaaggtaatgttattgaaatcaattctatggatgatttgaaagaacttggcattaccgcatactccggtgacactgaaaaggatttactgtttggaattccttattatcatatcaatcatttctttggaatacaaggaagcacaggacgtttgtttatcatgtttgcagactgtggtatagattggaatgctatagaacaaatgcaacgtgcagcacatggtatgattaaccaactcggcatttggagtgaacaatcgttgtggaaacaaacagatccggaagcagaaacatatagcattgatctagttacagatctgcaatccaaagctgcgtctttagctgatgaaaatgctcctttatcaatcttgttatgtgcaaattccgcagtaattgcaacagctgaagaatctgtaaagaaagtagaactgggcaaaataccgacatgtgttattaatgctcggtttgtcagtgtattgcttggtcagggattagacgctgatgtatcaactatgcagcttgctaacccaaatctcactcctgtaggaaatattggagctgcactcggatgtatcgcttcagcaagtgtacaagaatcattcgcatgggtaaataagttcaatttgattggttatttcccagatattgaaatgggattcggagatgtcactttaaatagcgaggataagttaacaagtacattaaagtactcatctttgaataaaatccaattggatgatctggacgataagggatatatcttcttgtgcaaatattctggtttggaaagtggagtttttttctctaaagaccaaacatgttcaaatggagattaccgaacagttgctagaaaccgtacaattcataagtcaagacgcgctgtacgtaacgcattattgccttatgtcaactctccgttgaaagtagaccccagcactggatatttatcttctgcaaagattacgatgtttcaaaatattgtttctgacatcctcacaaccatgcagactaatgaagaaatctctggcttttctgtaacaattgataagaatcaaaatgtattaaagaatgatacactgatcattaaatattcacttgttccggtgggtgtagcgtcccgtattgaagtagtcgagggcttggcattaaccaataaataattaacaagatggcaataattaacaatgtagcatacagctggtctatgatccgcatttccataccagcattggatatttcagaagattctactattatgcaaggagtttctgaaatcaagtggaacaagactcgtaaagttgaaaataactacggtattggaggaaatgctatcaatcgtggttttggcaataaaacctgtacagcctccattacaatggattataataccgtttcccaacttcgagcattggctggttctttaatggatttgggagaatttgacttgatcatctcatttactaatgcttatgccggtgaagactggaccgctgaaactgtaacgctaaagggatgtctctttaacgaagacggaatggaaagtaaacaagatgatacaaacattacgaaagaattcaatttgaatcctttcgatattatcacaggagaaggaactagttcttggctataacttctgatatatcatgcaataaaggcgagtaaaaactcgccttttcttatataaaaagggaaaaccatttttcaacagtttcccttttacatccctacatagagtacactcgaaattaatctcatgtactactattttcatgcaaaaataataacataaaatgaaaaataaaagtctaaccaataaaaatatacaatcattcaatatttaacattttaaatgcaagaccaataaaccaacgatttccagaacttctattcttggataaacatcaataatcataattataatggaaaatgtaaacgaagatcttttcttgcctgaagatattcagaccgagattgaaaagaaagtaaaagagctgaaagattcagatcccaaattaaaacgtgtattcccgatttttgtggaaggagatgaagacgaaggcgaaaagccatattatatcggttattttaaacagccgcctttcccgacattcagtaaatatttgtccctctcccaaaaggaccaggccggtgccatgcgagaattggcaaaagattgctttgtcgatggcgacaaagaactgattaaagatgattccttattcatctatggcttaatgccacacctggctcaaatcatcgagttgcgcaaaggaaaactcgtaaatttatcaaaagctgggaagtaaaagacgatcaacttattcgtcatagactgatatttatccgtcattattttcccagcgtaaaccttgatgagttaaacgatgaagaatttgcaatgctttctgaagatgccgtatggctccacagcaaaatgctcataactcaacaagcaagtgcacttggaatgcttgcgtaaagtgtcttattactcgttttttctacgtagccctttatcctctgtcggataaggggctttttcaatctttcagggtaccaaaccgctattctttagaaaatcaaaatacaaaaagatggcagaaaattatattgttaattatcagataaacgttaactctaatccagctttagagtctatacgtaaatttcagcaggccacagctgaaatggaatcattaacaaagcgatttgatattgttgcaaaaagcatcggtaaggttaattcagcattggcttctattaagaccaaacctataaacatacaaatcaatacaagtgcagccgaagcaagtttagatcgcatcttaactaaactcaataatataaaatcacaggcaaagactgcattaggtaaacctttatattcaacttcggatataaagaaattgaatcaagctattagttctataaatggtaaaacgattgagccaaaggctaatacagaaagagcaataagtagtcttgataagttaatacagaaaatagaacagattaagtcgaatagtaaaataaccattacagccagtgccgctggcgcatctaagggggtatctggtagcacaactagaaatacgacttccacttcaacacgacagactggagcaggacgaagtacttatctgtatccatctactcggcaagtattaggtccaacatacgccaacacaggtacaaatgttgcaggcgaaatgattaaggggatgggaattgcctatgggcttagctctttaatgtctggagtaacttctgtatttagagatgcttctacctatgataatatagctaaaacgacaaagaatatcctccagactcacgataaaggtgtagggtttaaaggtcggtttaatgaaatgaaccagctcatgcgccaagtcggtgttgagactaaatatacagccccacaagttgcatcagctggaaaattcttagctatggcaggatttaatgtcgatcaaataaaacatgccatccggcctatatctgatattgcactagtaggtgatacagatttgggagaaacagcggatgttgtaaccaacattatgaccgcctatgaaatccctgcaaaacagatggataacacagctgacattcttacgatgacgttcacaaaaacgaatacaacattgttagaattagctgaatcatttaaatatgccggtactgtcgcccatcaatcagggctagattttgaaactgcttcggcagcttttggtgtattaggcgatgccggtatcaaaggttctcacgcaggtactacgttacgtatgatgctattaaatatgatgaaccctactaaaagaggtcaagaagcatgggacatattaggcatcaacacaaaagataaaaacggaaatcttcggaatctctctgacattttaagtgatttacatgaaaaacagcaaaccatgagtgctggtgatttctcaacactaatcaacaagatgtttcgggtaacagcggctccaggtgcactggcattaataaataatgtagcaaaaatgcaagaagtaaccggactcaataaaaagtctatggggcttgcatccgaccttgctgacgaaaagaaaaacaccatacaaggtctttggtatcagatgacctcggcatttacagaaactggaatgcaagggtttgaacaaatgcaaggagtaatccgagacttcctacaacgcatgattgagttaatgaaatccacagagtttgcaactgcattgagaaatgcaatggacattttcattaaagtattagatgttatcgttgatgtatttaaaaagatcatgtctatttggaatttcctacccaactggctaaaaaatggagttgtatggtttgtaaaaattcaaatggaattaggtattattgctggtattggacaaagtatattaagtacagcattaatgattcgtggggtattcatgggggattggctatctaaattctttttaaagccactgtttaccgcacttacttatatgatacgcatatacaatatagaaaaaagccgccataatttaagtaagggacaggctattttcaatgcgttaggtggaggtttactacatggtggaagtaaaattaaacaatggtttgttggaggaggcacagtcggtaatgttgtagcaaatagtaataataagactataagtacccttacagaaataagcaatacaacattatggggagcaataaaagggcttacacgttttttcttaactaatccaattggttggggattaagcgcagcttatacaatctataaacttggttcatatatatatcaaacacaaagaataacagaagctgctcgtcaagccaatgaagcatgggcacaaagttatcgtaatttgaatattgacaagttgaatctatctgacccagatgccttaatgattggaaatatgcgtattttcaataatgaattgttaacccaaaacgagcgtatcgcccagtctacggaattatggcatcgttactggatagaaaagaatggtccaaaacaaagtgtagacgaccaaaccaaattctttgacacagccgcaggtagagacccggaattactaaaacgattagaagccgcagaccaatggacaggtgtagataaagccttccagtcattgtccagtgcactgggaatgaaacagactgtcaaaaaaggtctgaacggcgaaaattattatgcgtatgagttacatggccgtactttaagtggaaccaatactaatatctttgcaaaaaacggagatataagcgaacaagtggccgtccaaatgatgctggctcaattagcagaccataattctaaagagaatatggctttgagcaaatatcttttgcacaatgccacttctgctcgtagttcggaagatctatcgaatatactaaagaatgcagcagataggtttatacctaagatgggtagttgggattctcgatgggactggattagcacagaaacattccatgataagatgaccgaaggcgatgtacaccgctcacaagcatatatacgtcatctagctcaaattatgaaaggaacaataagtgcatgggatgattacgcttcaattcttaaagattttgagtctggagaaacaatagacccaacaagaacccagaaagtattacaagggttatttggaccgttgtttgatccaactaaagggctatttggcacagaaggatggtcaaagcatgtacaagatattgttaacaatccgggaaaatacaaactagaaagtcaacaagaagcaatagattatattactgaaacctttgataagttagtttcttggtataacgatttgtattatggacataagtctttgttcgctccgttcataaatagaatacctattcaaaatcttctttctgaaggagatgttcttcctatgggcggtttttatggtccacagaaagaaggtgataaagcgatttttgacggggcacagtatatagctaaaacaatagctccatacgctactccacagtgggtagataaaagtgggaaaatatatacccctaaaaatgctaaagatacatttaagtgggaccctacgactggtaacaaagagcaagatttggcttccagccttcataatggagccgaccagtctcaatatagaagtcataataattataatgcagctcctaaacaactgatagtacgaatagaaaatctaatgcgtgtggatcatcaaacaattgatatgacagatgatagacaagtcgcggcaataacaaacgtaaaacaagaattagcaaccgccttgttagatgtagttcaagattttaatgcaaatatgatgtaatatgagttttataagctctacattttctaatttaacgattaatgttggtaaagggctggcaaacaccggtgtgaatgccgccttttatgcagttaactatagaaaaagagatggacaattgaaatttatatccaatagaggatatagtaatgtatttgtttatgcagccaaaagaacgatgatgcagatgacttttgccaccatcaacgatctttatcccaaatatatacgccagttggacagaaagaatgctaccgcagcctatcagaagaaccaaggtcaagagcttcagaaaatcataacgaacggtcagaaagcagatgaagatacctttaataaacaaggagttgtattaaagtatcaaggcaaacctgccaatgaaggtttacttctttggattaaaaatgaaagcggccaggttcaaacggttcaattcaatacttattgggataaaataaaaggattgagcaatgaagctgccgccagttcatcacttaacactgctacggaagtaaaggtgcccggcgatcctgttttcttagacttaggtgctatagtgcaagtacaaagctctaacaatcttgtattaaccaaggtacaaggaagagattattcacgtaaagaattgatttcaggaggcgatataaattttactgtaacaggaaagattgttagcaattatccagatgtatatccgtatgcagaagtttccaaatttataacattgatgcaacataaaggagttatccaggtatttaatctcatgtttcaacagttcaatgtgacacaaattctgataaaagacttcaatatggggcaaaatgaaggctttaagaatgttcaaccatatagttttacatgtgttgccgttgaaccggatgacgcggttaatgtagtgcaagataccataaatggaacaaaccttgaaatctctcaaatgaaaaaacaaggttgggctaaagttcttcttgataaggttaaagcatctgctgctaatcaagctgctcaaatgattgaatcattaacttctaacaccatttaagtatgaaacttccagaagcaataattgtagatggtaaagaatgccttgatgtattgtgctgtaaaatcctaatatgggaagctaatagtgacgttatagaaattaacgatccagatgaaaataaatgccttgttattcgggaatgtgaaagtgttgagataaacgatacttataagaaacttattaattcagcttctgtcagattcccaagaggaaccgtaattaaacgcactataacttccgagaacatagaaaaagaaggtgcaactactatttatacagagcgtttaatagacggtacagttgtagaaaagcgaaaaggatattctacagcccagccgactgattttaaggtaggacaacgtatccggatatatttaggctattataaagatagaggaaaggtcttcaaaaatgcgaccgagagacttcaggcaatggagaaagaggcatttgtcaagaacgttcccgattttgacggttatatcgtaaaatgcagtgtaagcacacctattgaaatcaaatgtgagaatctggcaagtgggctaaaacgaaaaaatgtcgttaaattaggcccaatgactgttacagtaaacgatttgttgaaagagggaggaaaatacgatttattaaaaggaacagggttaaaattgcatcccaaaacagcagaaagggacattaatattggcaagattcagttaacggaagatttgacagttgcggatgtattaacagaatggaataaatacgggctatatagttttattaggaaagatacagatggaactccttatgttatggtagggcatacttatttatcaggaaatgttgccagctctattttaaatacagatggaagttctgatactcctcaaatacagtttgattatcatgtagcccaagacaatttaactttgatgaattgtgatccccgatatttagcggtctccgctgaaggattcaagtttgagggtaacaaacaaatcaagtataatgtaacagttcgtttaaatccagaatggaccggacaaaatgatacagaacataagaaattccaaattctgaatgaaacaaaacttagcaagaaatccctaaaacttggagctatccccaaatcaaagactaaggatagagtaaacctaagtgcgtacaacgttatcccttatgtatcatccaaaattggcattagcgaggacgaattaataaaagaagccgaggccttttttgaaggatataatagaaatggcgttgagggtagtattactatcttcggagatttacacagaactaatttaggcatgaggcatttggaatctggaatgaaagttgttttacttgataaacgcgaacctgaaaaacaaggttggtatcttattgaagaaatcaacactaaatttggtgttaacggttttaggcagactttaaaactcccctactgtattgccaaaccagaaaaagaataaaactatggcagataaaattacaagcgatttaagcgcaaacagtgctatttatgatgctatacgacaaattgcatttcataaattggtaaacccacgaaacaacgttataaaaaacacagccaaaatatctggttttgttgttaaaatacatacagatggagaactgtgtggaactgttgatgtacaggaatatactcatacacttacagacaaacaggctattgatgacgggcttccagttggtttacatgaaggcgtatatctttcagctattcaaaataatgaaaatggtttagtggttatcccctatctttattcggatgtcgtaataacaacagatcctgaaacattacgcgaatatgttattcaatactctcatgcagacacaatacaagtagacgcgcataacaaagtaattattggagcaacagaaacaaaagaatgggaagattcagaggatactccagatgtagatgaattggaaaagacaggtgttcatgctcacacgacttatacccctgtttcgatattgtcggaagttactaaaggagaaggagaaagtgataaaagtatattcaaaataaccgctgacgatattttatcccaacatgataaaagtcaaatacttcttgatgcccaacagattttggcaaaatataatacaaaagaaattataatcagagaagatggagtgtatttgggtagcggtagtgccaatgaaccggcagtacttggaaatcaattagcaactttattggttgactggctaggagcattatctcaaatgatgaccccaactatgatgggacctcaacctccagctaatttggcaaagtttgtatcccttcaagcaaaagttaactcctataaagcatctatatcaggatttttatcaaaaaccgtaaaagtggcagaataatggcaaagttaaatgaaggtatatcacaaattaagaaaggtagtgcattggaaacaatgtacaaccggctcttaacagggatggaacaagcttcacacgaaacacttccagattttacaggttcggattatgtggatggttatgtcgtgaatgaagaaaaaatcaatcttgaaatacatgaatatgaaaatataaccagaaagaactctgcatatctattagcaaatactattataagtagtttaagcagtgaagaaggcggcggaagtggcaccggtgggtttgtttccataaatggtgactctatggccggtttattaaaggcattgtatggttttacagccggagacaatggaataaaaatattggatgtttaccaaacgtccgaaagtaatccacaagagcgaaaaaatatagtttctattaacggtgaattgcatctccccacacatggattatacattaacggttgtaatgttataagttatgataatgatataatcgcattaaacggcgatgttatttgtagtggatatattagacttggagatttagaaatatccaaggatggcattagctatcaaggaaacgagttttatcattctgggaattcaaataaagaagatgtaagctggaccatgaaagatggaacggttgccggaaacttgtctgtaaaaggtacaagcacattccaatctggcattaccgccttgcatggtgtagatctgggatttgataatacaagtgtattgtctatttctgccaaacggttagctcaattaacgggggacttaaatattgtaacaggaggcataaaatttgatgataattacattattcatgtcaagaataacaatgttatctcattttctgcgtctaacaaaatattaaatctgggagacgataataccaaacaaatcaacctgcaaaccagtatttatgatgatgatggtgaatatgaaatgatttcaaaatttggttctgcatatttcccagaatcatttaaggcaggacataatctagggaatatattgattgaaacatataaaaaatcgtctgaagattctggtgtaatattcagacgttatattagattaaaatcagaagatggaccaggattttacagtgatggtgatagcgtattttttgaagctccatttaaatataataaagtagctgatgacgatacagtacaaatctctgaaataataaaatcatcatttggctatgtagaatcgttaagtttatatgctccattaaatcgcaaatcatccagcttaatgttttctacagatgctgatttttttgtttttgacaaaccgattgaaggaaaaaaatcaattggaatagcagattctaaaacccgtctcctccccaacgagctattctttgatgattcaatctattggttggctttagataatggagttaagcactatggtaatgcctattttgtcaacgacataggttctgtcactttttccagtggttttgccggaaatggctggggtatcattcaaaacaaattgaccggcaacatcagtgcaacatttgatgatctgacaattcgtaaaaaaatgagaatatacgaattggaagtgcagaagcaatcagtgactaacgggtcttggtgggtcagcgatgcctgttccggagacttagtagaagaaatatcataatgtctgtatataaatacaagaaatataaaatttctctccagtccgattctaaaaagacacaaggattacggactggggatatagttagaagacaatattttgatggaaagaatcttatttattcgttaatgtgtgtattggattatggaatagataagactgtagattctaatacaaatgatattgtcgaaaaacagtatttcatcggagcactgttagaaggcgatgtgcccaaaacagaagaaatcttagactttgccagaattaccaatctgtttgatataaatagatctggagccatatatttaactgggtctgacgataatgccccatatatggatgtgattgacggtattggacgtaatgagagtttatgttggccttcaaatattgcaactcctgattatgaagattccgaatcacaatatatagtacgaggaacagaagcagtaaccactgattacatactatcagaagaggacaataatcgcatttgtcattttaaaagaaatgacgctatatattacggtttcattggtctgcaacaagatttctacaaatatgttcaaaaccccaaccgcgttcttatttcatataagatcaaagccaataaagctgtcaattgtaaagtttcattagaataccaagatggaacaagaacagatggagaagaaaccacttctattacaacagattggcaatataagttgcacacaataactgtcgattattctggacgttatttgcgaacagtaaaactggatttaagtgagatgtctccttcagatgaagtttgggtgtcggatttcaatatcatcttactgtctagtgttgctaactttggcgatgccagtaaaatacgtgttggcaaattgaatggaataacagatccggtatttggtcaattagaaggatatggaggttacttacagaaactttttgcttcaaaatctgctcatatttctggaacattaactgctggtgatgagaatggttttgctgcaactttttatgccggaaaaattcataggaatgtattcgttaattctttagatgttaattttacatctgcaattactattgacactcaaatagaaaaccctactggaatcggcaatgtatatagtgcctctaaaatcataagcatgatagcccaatctgaagagtggttcgcgcaacatatcgggaaaaaatatacattctctttttggatatatgcggggcaagcatgtcaattatctattttacaaaatgataaagcaataggaaccgttcaaatacctattgctgacacgaatatatggtctcgtaaaaaggtaacatttgaattacaagctccgaaacaggcagaagaagcattggttctatccattgtcccaacttttgatacctctgataatgcaggagaatcaatattttatttttcttcaccacaattagaggcaggagaactagtcacacaataccaacctactgacactatacttaattacacagaggattatggagcttggtttaatcgtggtggcattggtgggaccatccagaacccattgcttcaattaaattttgacggagaaggcagtattggtactcgtagtaattctgtattaatcaaaacagatggttctggtcattttgccaataaaaatattaaatggaataaaaatggcgatgtaacatttggcaaaaatgtgacaatgacttgggataaccttgaccagtctgtaaaagacgaattagtcagtaagtctattcgtattgttggaactgatacctttactcttttaggagacttaacaggagccgaccctgttactaatccggcagacattaccttaacgctggaagaagagaacctacagtctacttccagtcaacgacaatggtattatttacaaggatatgattatataccgtttgaaggagaaaatggaaagacattaacaatatggccttttgaaccttattgggataatggtaactcgttaacagttcgttgtatcgtgaaatttagtgatgaagagtattccgctacattcacaatacggaaacaatatatagtgggctattcacttgaaattacttccagtcaaggagtatcatataaaaacaatagttgtcaaactgttttaaccgctaacgtctattatcaaggtaaactagttgatccggattatgtagctaaaaactacatattcaagtggactaggtatcatcttcctgatatggaaaatgaagtgattgattggtggaaagaacaaagagataatgaaggcaatatagtacaacaagaaattgatagatcaaaaccaagtatcacattaaattatggaatatcaggacaagactgttttatgtgtgaacttctaaacggtaacatgttcccgtatgaattccctttaatattttaagtatggcggcagaacaagagcaatcccctaacctgcttgattttaataataagcaagaaaacaatggaactaataaccgtggacgtttaacagctcacgaatttaatcaattgataaatgccgtaaacaacaactcaaatgacacttttaccatgaaaaaacaagtaggcaatctttcatttgatgtagttgagaatgaagaggcatttgaacaaattgaatccaaagaagaaaataccgtttatttcatacttgaagaatgatacagataaatggcaaagatgtcagtcaaataagagttggtaacaaaatagttaccgcagtttacataggggcaaaattagtttggcaatctatacgctcctgctttggatctggtttctggattaactcatcttcttggaaaaatgatgaaggctggaaaaactaacaaatttttaaattacgctttacaaaaaaataattaattatggctaagaaattcagaactgacgaaattcctgctggtaaatttacagaggactggggtggcaataaaaacaataccatccccgcagcacctgatgaaacgaaccttctcccctactctggggaggctgtgcaaaagtttataaagagctatttgcaagaccatgaaaacaataaaattggtcacattcctcctatgacaaaagatccggacggtttttatcatattcgagcatttgctaataaaaacacatataatgaatggcttgctgaccctgatgagaatcaagcactaaaattgcttgatgttactattcctattagtgacgaacagggtgtaatgaatattgtagaattaaccacggccagcaatcaaacaaattatgtaagcattgatggtagtgtagttctaaaaatgcgttttacttctcaaacatacaatcctgttactgggaaatacgcaaatacctatgaagatggtactatgactatccaaaggcgtgcctccgcttccgattcttggcgtacaattggtacaatggcaatcaagagtgtagaagccgaaagtgacacttatacggatgtagatattagtggattacttaacagtggaacctgtcaattacgtatcattgtaactggagaccaaacacaaagtaccacaacttatgtagtgttccaaagtgttacaaaaacagaattgaaacttacgttccgaaacgaatggcagcaacctattactggtgccactatgtctttattatatacatatactggtgccgtagctaaaacattaaatttaaaaattagtggtgaaggtggtgtacgttctgtccaatacgctgttggcaaagttgagtacacggaaaccccaaatcagtttgatgtaaccgacactgaaggggattctgttaaagttatgtctcatggagtacatgaaattgaggcttggttatctgtagacggcacagatgtggaaagcgaacacattgtttcacaggtaatggtagtttcagaccctgataataagactccatatattatgttgaaccagatagtcaagtctcttgtaaactggacatccgttcaatttttccaatgggcaatatataacccaagttcagatgtattacctgttacttttaaattaacagacattcaagaggttgagaattatctgtcttacactgaacagcaagcccaaaatggtgtggtttacacatttggcaatatgatagaaatcgaaagcaaagaaacgaatttcagtgcttatatgttatttagcactggagaaaaatacttgcgtgatcgtattagttttaatatcgataactcacaaaattttgccccgactgatggtgccgatttaattatcaatcccaaactacgtagtaatactgaaacccacccagatactattattaataccgtttcaggcgataatgttcctgcgacctttgaaaattttggttttattagtgatggttgggttgaagacgataatgggatcaaatgtttgcgtgttcctagtggaagaaatatagcaattgattatgagacgttctccgactttatccaagctcaaaaaacaggttctcttacatttgaaatagactatgctattcgcaatgtaaccaacgaagacgaaccggtattacgcatgtgttcttacacaaaagataataatccgctaggttgggaaatgaaacctattgatgcctgttttatgacccaatccaaagtaacccgtaaaaatcaagacgttggctacaacgaaggggtacgcactaaaatcgcagtcaatctactatacaatttgtccagcactggacaaaactattgccgtattttcataaacgggattattaaccgtgaaatcaattatgcgacagacgatactttcgtacaatatgtagacggaaagcaaacatcacaaggtatccgtattggtagttctggagccgacattgacatttacagcattaaggtatataagaaagcactcacagctaatgatgtgcgtcaaaactatatggcatccttagataatagtgaagaaaaaatagcatttcgcgattctaatagtattcttaatggtaatactatcagctacgatcttgcttatgaaaaatacaacgttatcctttggaaagggaaatatgccacttatggaaataccaaaaaggataaattcaatggtaccttaattatccatattcctggaaaaccagagaatagtggtacgctgtatgacatgaatgagaaaggacaaggaacatcgtctatgttgtatttttggtggaatggacaatggggcttcaatgaagatggatattgggttgatgagaatggagtaaatcgtggtaaatgttatcagttaaccaacgatgtacctggagcactcaaattggtagggaaagtaaattttgcaagttcagcacaaagtcataaaataggttctacagctctatttaatgatttatttaaagctgtatgtggaggtaattccattactaatacagaaggttttgaaaattgtcgtgtagctgtacttcaaaaaccgtttttgttctttgtacaagaagatgagaattccgaaccacaatttaaatcttttatgacttttgggccaggtaagggagacaaaccgacattcggatacgacaaaacaaaatttccagattatgtatgtctggaaggagctgataatgaccgtgctttggtgatgtgccgcgtaccttggattgatgaagatgttactttagaaggtgaagaagattggatgtataacggcgaaaagcaaatgagtttggtctttggagataccaataagatcgcccctatcaaaagtggatttaactttgtctttaaacattatgataatatagattatttcaacggtaccatcgaagatttaaatgcagcagaaaatcttgatacctccaaacattattggctggctaaatcggggcgtaacaatgcacagtttgatttattcaggtatgatttcattacttctacttgggtgggtgcaggcactgaaaagattgaaagtggaagatattcgactgtaaatatcaacgaacaatgcgggaatattgccagcggtacagattgggatgcaattaactcatcgttcaaaacggctagaatagcattgttcaaggctgatgcaggaaaatattttaatcttacagaaactcattttgctatgaatttttgtaagttaattgcagccagtgataacagaggaaagaatatatatttttatgttgacccaaaaactcatttaattggttggcatcaagatgatttggacacaatatttcctgtaaataatgtagggcaaagagaaaaaccttactatgtagaagaacatgataaaaacaatgatggaggtttttattggaatagcgaaggaaatgcactattcaaccaaatggaaaatgcctttccagatgaattgcgtaccaacatgcgctctatattacaagcaatgcttaaattaagtgatgatggaactttaatgggttgtatggaaaaatattatttttacgtacaacgttatttcccagccgttgcttacaatgaagtggctcgtcttgtatatgaacgtgctagaaccgcctatgtgagttcagacccggaaaataaatacacaaatggtacagatcccataacacaaagtttaggagatggattacaagcagaaatgcaatgggttgcacgcagacttacctacatatcttcttatgcagcctttggagactttggaaggcgtgacggtgaaggatcagcaggctcattaaacttccggtctataataaaaacagatggtacacgtccacaatttaaattttctattgtaccacatatttggatgtacccctcatttgccataggctcgacactatcttatggagttggtaacgcactgtctccacgtattaaagccggagaaacatacgatgtcaatgttggaacttcagatggcaatactaacattttcttaaatggtattgattatatgcgttccattggtgactttacagacaaaagtttaggagaaacatttaatttaagcggtgctcgcctaacagcttttcatgtggatggaaaagatgttgttgaattccgtcctactggtatgactattactgcccctttgttgcaagaactagtattaaaacgtgtcgctagtttagtaggtggtttagatttatctattttgcttaaacttagaatgttgaatttagtaggaacaatgttgtcttccgttgttcttccagctaccgaatatttagaagaggttcatcttcctgggactctgacatctttgtctttagatcaacaacccaatttgagaactatcactttggaaggggctgaccgaatgcaaagtctgtcaattggcgcaggaattgcagattcgcgtaccatatttaatttatgctttacaggtaacgcaccgttgaattatttaaagttagcaagtataaactggaccgaggtttctctttatatgattaactatttggcttctattacagacagtagtgtatctggaaaaatagcagtaataaacaatactaccaaccgacctaattttaacaataaaattgattggttgtatcattggggaaatgtagatgatgagaacaacaatcttcatattacttactactcaactcctattgcagctatagaaatcaaaggaagccaatacatttattctacaggtgaacactctttttactgtaagccgaataccgctaatggaaatgatgtggttagcattcgttggtcattggataccaatttgtatgcaaaaatagtcaatacgtcaaaagattattgcgttatcaatgtatctcaattaggagatgaagatacattggctccacatacaactttaagatgttatctaacaaaaacaaatggtgatgtgcttgaagcatcatgggatattggtttataccccagacgtgctcatctcggagattacgtattttatgatggaacttatggtcctacaactgctggaaaaaccgtagttggaatttgtttttacataaatccagcagatgccaatgatagacgtatggtagcattatcaaatcttgaaaattcaggtatagtatgggggctttatcctcaaaatacaggacaaacggaagagtggaatgaacaatatgcaatttatcctattgaattacaagatgatgttaattatagtgtatatgatataggttcaattgctaacattacacagactggcttacaacctacagaatatgacgaccaaggtaatacctctcctaactacataaggtatgataattatgtagatgaaaatacaattgacggatttgtaaattcagatgttaaaacagttgctgttggagatggtatcgctgctccaggtacgactaatacaggaaaagaggaattggctgcggatttagccattttatcaggtgcctataaaaaaggtgacgaagttcctgtcggtttagcaaaaactttaaaaattattcaacatagaaataaaatcttagaagattcaggagttaatttgccgatacctgaagcgactgacttatatactgaacaagcgatgttgacccagtatataaataacataattgctaacaatgaaaatcttagtaaatatcaacaattttattatcctgctgccagcaaatgctatgcttatcaacctacagtaaaagcaggcgaagaattggcagataaatttaaatatcataattggtacctaccatctgttggtgaacttatgcgtatgtattggcacgctagacaaggagtgaattatgatgatgataaaataggtgcaatttttcaaaaagcaatagatgccggtattttgaatgatttttctaattcttggtactggagtagcagtgagggcagtcagaacggcagctggggcgtgaactttagtaatggcggcttcaccggcaacggcaagtgctacagtggcatggtaagagcggttgcagcattttagtatagtggagcgtcttttgacgctccacaaaaataaatatgccataattgtaaacctctacagaaaaaataaagtattcgtaaataaactatatgtaataagacacattgtgaataaaatcttttaattatggcaagaacaattcgtaatgcaggaagtgcacctatttacagagaaacagaaaatttaatgttactctgtatagaaatggtagaacgaactcctaatagtgtaggaattcgtcaattaagcaaacgtctcatagacactctgcttgatggattaacagtgataggattggctttaaatgaagaagaccctgattccaaacttgagcttattaattcattttatttgcaaatgcgtacagtgaaaacttgcattgacaccttaaaagagtggtcaaatcggagtcctcatacacgcataattagcaacaagcaaatgccacattttgctgaatctttaaaggaaatttcaaagcatattaaaagctggagaagcaaagtgttggagcagcagacctgttgaacggttacgactatgataacagggacatctttattgaaaaatgggcgtgtcactgggcctttaccaagcgttaaagacctagttaagaacaagatagtacacgcaataaccgcaagccggtactggagtagcagtgagaacagtcagaacaacagctggaacgtgaactttagtaatggcaacttcaacaacaacaacaagtacaacagtaacatggtaagagcggttgcagcacttaacgataaatatgtcgagggatggtttgatgcgttagatgattgctgtgcccaaaaaaagacaagttcacaatgtgttatgtatagacttatttggcatgaagatctattagatttagcgagagaagtttatgaacgaacatatagaccaacaacaagtacttgttttatagttacccgtcctaaattacgggaagtgtttgctgcaaatttccgtgaccgtattgtacaacattggttgtgcctacgcttagagccactgtttgaggcacgttttgttgaacacggaaatgtatcatttaactgtcgaaagggttttggaacatttgcatgtattgatcagttgacaaaaaatacaattgaagtctctgataattattcgcacgaggcttggtatgctcaatttgatattaaaggattttttatgtcaattgattgcgaacgattattagaacacttattaccatttatcaaagaaaaatggaattattggaaagggaccatatatgaacaagatttagatttagtgctatggcttacagaaataattgtacgacatcgaccacaagatgattgcatacgtcaaggaaatttaaaattatggagaatactgcctaaaaacaaaagcctgttttacaatgaatggatgaaaggcgaaccaataggaaacctaaccagtcaattatttgccaatttttacatgtcattttttgatgaatgggctattaaagcagcagaagaaagaggagccaaatatgtacgttttgtagatgattttggctttgtatgtaaaactaaggaagatgcaatatattttaaaagagcttctaggaatcaactacggtatatcttaaatattcaaatgcaccctaataaaatctatattcaagaagttaaaaaaggaataaaaatggtaggaggagtaattaagccgggtagagcttacttatcgaatagaactgttggaaactttattaatgctgtaagttatttagaagaagcatgtaaaaactgtgacaaggaagctatatatgccaatgtgagatctataaactcttatttaggtttcttaattcattatcagtcatacgggatcaggcgcaaagcattttcagaactacattatttttggaaagcttgctatattcaaggaaaatttcaagttgtaaaaataaaaaacacagtacaatgtttatagcttataatcaaggtaatgagcaacctcaacgcatacgacacaatataaaattagggttgcgtcaatacacaattgcatttgatgttaatttagtaaaagaaggtgaaaatgaacaatacaaatggtgtgagataacccttccagttggaatgcccacatatagccaattggtttcagctattattcatggacggtactctgatgatgcaatgcaagccattattaataatcacctcctagaagatgaagatagtgaacatcaaaaggaatggaatgacatgcaaatgtggagaatggaagcaaaacgtatggccaaggaaatattggaagaaataaagaaatagtttatctattcccacatcaacaaatactttgttcaagggctattcttttgaaaaagtaatttatgggaacagtagcaaaatcttctatcacacttgtatctattagcgatgcttattcgttatcgctaacccctaactcgtgtgtgattaaagcagatttcgatggttctaaccctaaattagaacatgcttatactattatttcagcatattgtggagatgagaaaaccccaatagaaattgattccagcactattataaaaagtaacgataatatagaatgtcaactaataaaagttgatagctatagataccggttatctattatatcacttcctattgatatattacaaggatacattgaaattccagttctttctggagtaagtgcagggttaactgggcgtttcacattttctattgtacgcgaaagtactatgctggactggattcaagattgggaaagcaataaaacaactattggctcttcttatgtgattactcccaagatatttgttggaaaaaaaataattggcagtcacgacagtcttgaagatgttccaggattaacgggggtatatattggtccttcagaaaataatggagctggtatatatggatataaagataacaaagagatttttcatatagatcagactggagggaaaataggtggttgggatattacttctggtggtattcaatgtgaagatggcacattatccataaaatcagaaggagccatttctgctcaaagtgaagacatcattcattggtcattaaacaaagacggttcagcctcttttgccaatggtaatgttacaatggatgttgagggaaacgcctcatttaaaggaacaatagaaacatctggtggtagcattgcaggatggactataggagtcgatagtatttacaatggaactatagggatcaattcattaaaaaaattcattgccatcgccaatgttacttccgtccaggatactggcgatcaattagactgggtaaaagaatatggcggtgttgcaatgtactatatcagcaatgccgattatggtttgataggatataaaaataacgaaaaagtattttctgccggttctaaaaattttatagctggatggcaatttgataaatctgctatttggttaggtactaaaaataataatgttggacaatatacatcaacttccggaagtataacgattggcaccaatgggtttcgcggatattcatggtttattaatgcagacggttcagcctcttttgccaatggaaattttttttgggatacaaaaggaaacgttactctcaatggaaaaatcattgcgactagtggtactattggagatatagaaatatatgaagatcatattggaataacttcaactcctaattcttcgggttctgggcaatgggcaggattatctatttataaagattttttcaaagttggcggttctaaaggatatgtgatgtttggtaatgatgtaattcctgcttcaacaggtggagcatttacagcagttgggcgcattgtcaaccaagctccaaatacatctggtggttatggatatgaccaagctaactatgggctttttattgaagtgacaggaggaactaaaaattatggaatcagttcaaatgcagctttaaaagccccgtccttcattaatactaaagcggcattattaacatttggttctggtaattataccatagatttttcacaatttaatgtgatattgatgtattttaatgatcccaattacgatgttgttgaagtgaccttaccaaatgaaagtagtgtagctcggcagtttggtgtaaataatttgcctacagattttgccacagtaataacttttagagtaagatcctattcaaaagacattatattaaaaaacatttatgatcataatgaaaatatgattgattatcgaatggtcaaaggggattctattattgtattaattagcaaaattgacgggtttaggtatcaaatattaaatcattcacactaatgagaaaagacatacagataaatacaacgacaggtgatatagtgttcaaaaaccgaaatacattaaataaacaattgtttaaatggctttcagagagcgatttgtttattaccgcacaaatatcgttaccttccaattttgatgtaaatcagctttatacaattggagttaatattgagattccttatactccaatatataaacctattaaaatacgtattattagagatttcggtggtggaaatgtacgcgttgtgattaatccgaccaataattcagaatggtttgaggtatatacaaaattgttcggggcacaagataaggttttatatgcttcacaactaatcatggttaaccaagataattacttgttgcaacttaatgaaggcaacgcgtatttgtggtccggcattatgtcagatatggtaaatataaatgcaaatattcaaaatagaaatttactattacaatgcattccatcaaataattatagatacccaacttcaggtgtgggcttaattaaatatcttcatgccaaccttagtcattcaggattagcagaaaagttacaaacagaattcaaagatgataaagtggagattattaatgccgcttttaattcctattcaggagatctggaattagacttagatttttcagaagcagatgcaggtgtataaagtaaaaagaaatcagaacatatttgatgtcgcagtaagcacacatggttctatagaaggtatattcgatttgttaatcaacaatcctgatttatcctttcactcacaattaaaagaaggtgaagaaatatattgggatgaagaatttattatatatgacagtattgtaaatacgttacaagtagaacatatcgtaccggcaaatggagagagacatgtatattataaaaacacaacagctcccttacgatgcgtcatgtacatatctccagaagaagcatctattgcattacaaatggcaggagacggaagtcttattgttgattggggagacaacagtgatttggaaactataacgctatcccccactctacaaaaatatgtgcattttttcgataattataccgatgaaaggtcaattaaattgtatggtgatttcaatttaaaaacctgggatttgtcttctattaatggcttaatgatgccaactatgccgctggtggtagacgagataatttcggagaagaacaatctctctctgcaaggactatttttatgtaaaggtacatatttagtgaaactggctagcatgagtttatccagtcttgcccccattcaggatatgaatttatctaatttggagttaagaaatatcaattatacaaaagacacagttatcaatgactacttaatctatattgcaaagcataataatcaacgaagggattgtaaagttatattagatatacaaccctctggaacatataaggagccgcttaaagacagtaatggcaattatgttattacaactggtatggaagcgatatacgtgattacccatgaaactgcatggaatgaagtgggttcatggagttttgatataaatggaacgatttatcaatatgaaaattcagacatagcatgagccgtacattaacagaaatatacaatgaagccgtggagaccagaaacaaatacctggaacttacagagctaacaaatgactcaaagatgtcaataatcaatgctttcacatgggtaacagccgctgcaatctactcatttgaaacattgttagacgtttttaccacagatattgctaaaacctttacccaacgaattaatgggacttcagcatattacgcaaatgccatgttgaaatggcaatatggagatgatctaattatcaatgatgaaggtacagcatttcattatgcaactgaagatacaacaaaaagattgattacacatgtatcttatcaagagtattataatgaagaattcaaagataatattttgatattaaaagttgcttctggagaaggtcgttctttgtcccaattgtctgatgaggaactaattgcagcacgtgcatatcttaatcagattaaatttgcaggtgttaagtgtaatgtagttagtcgcagaggcgatgtgcttgttcccagactcaccgtgtattatgatggagccattacgaaagaggaactttatgataatattgatacagcacttattgattttattgtaaatatgaaatttgattctcttgtctactcacaaaaaattatagatgccattcaaaaagtagagcatgttacagatgttcatattgaccatgaagctagtgtagaacaaggaatttttatcgctcaatacaatgacaataatgaactcggaccattaaccaaaattgagcggaagtgttatttagctagcggttatgcaaaacaaagtacacagcaagatgcagaaagtgaacttcccacctttcgtgaggcaattgttataaaactagaaacagaatgagaagttatcgtattaatactgaccgtatagtaaatcagttagttcctcattatcttggaggacgaaaactgatattatttcttcaggccattttacaaccgttaaactctttgaatgtaaaatggaaagaatgggctgacgaaaaacgaatagaagcagcaatgacctcccaggttattatgatggaatattttttaaatcataaatttaggaagtattttttagacacctctgaacatattgtcatttcagatggtgctataaatggagtaccgatatattgggaagatgctaataaaaatatatgcgaacttcctttgtataacgaaggcgaaaccgaagttagcggacacccaaccactccattgcgttggaaagatgaaaagatgccaacaagtgatgtaagttttgtagtaagttgtcctgctattaataccaagacaatctcacaagaggagcttacagctatgattacttattatgtagatcgttatcgtattgcaggaaaaaaatttaaagttacatacgcttaaatgaaagagtttacttcacaaacaggtgggcgttacacctacattgatgatattatgaatttacagaatcttgcattagcttttacaagcatatttgatgagtgtgataactttattatcagcggatgtcaagtgtcaggtacaagtattagtgcagggtatgtctatatcaatggtaaaatacgttattgcacaggaacatctggagtctctaaatggcctatgtatttgtatgagaacaactcggttgaacgtgtgtcttatgccgattccggagataaaatcggacggaatatatacggatgtgctgtatcatccagtgtaccaataaccaatgatgtactaactgaagcaccacctcaatttatcagtattgcatcagatggcacagcacttcgacttaaagaagcgttatttggaaaatatgctttaatggtagattcccctaattcagttcagactgtacagaagaatgttgttattgatggaacagtaatagcaaataaagaccttacagcccaaaaagggattaatttaacatcaggaacagctaaagctagcataacctataatgcctctggagcattaagtattcaatcccaattaaatggaaagcctgtttacaaagtaactataacagaagacggagctattcaattttatattggagatactttattggcttcacttgactccaatggtatgacactaaaagtctcgatgtctttaaactctattaaggcaggaaatattgttatagctagtaatcatatatataatacagccgttgcagctgataccggtagtataaatatcaatatgttagggtacaatgaaggagactcctattatcgagacaccaaaattggcgatggaaaaaatactgttatactagaaatcacaggaaaatctaaatctagtattttttatggaccagtaaaaatatctcatgcggattcttcgatcctaagtttaaagaatgcctctcttcctaagacagacaatcaattgataacctgtttaaattgggaagacaaaaattcagaacaaatcggttatatggggtattccaatatctctaataaagatttatatatcaaaaataacattggaaacttggttctcaacaatgatgtatatgtaacaggaaaactattcgttggtggaattgatgttatagctagaactatagaatatcccaaagatagtggatggattgcaatcaatgttcagaactgtggtattacaacaaaactgtatgtccgtcaagttggaaaagtagtgtccattcaaggagaattacatacccatcacagtggtaccatatttacattaccaaacaccattgatcctcctaaatataaaataggttattcccataataaaggacgtggaaattggcattgtacaatacaaggcggacaacgtaattgtgtagttgattattgcaataatggatgttcagaatacatcggatttttaatgacatatattatttaaattatgaagattattaatgttagcgttgatattgagagtcaacgtttaaattctcggtcaacatcgtctcaaaaaaatgaacataatgaaaacgtttccgaacagcagaaagaaaccaaaacgccgcaaaaaaaagcccggaagaccaaagggacacagcctgaaaaacttcgaccagacacggatcgggtttctgatgaaacatgaagttcctatagaatataaactattaatggaagtatctggcttcctaaaaattcatgcaccatctccagaactgattgaagcaataagctatgcctcagatgacatattcttcaaaaaggctaagttctggagatgtttaatggattataaaaagtatggtttaagacctccatatagtattcatacaaacgcaaataaggaattatattatatacatttaagatttaaaaagtatctaatttgacttattcaaattatcaaattagatacttttttatatctataatcttgtaaataagaaaataattagtaatttcgcatcacaattgatacacacgatcttttatattgacttttaacacagtaaattcatgcacaaggtatcgcgctttttcaagcctttaccatgtcctaccccagctcctaaaaaactgtacctattaaaatgcgaagcaactggattatataaaattggagcaacaagcgaggatgtaaaaaatcgtattagtaagctgtattataatagccacactgatcaacgaacaattaaaattataaaagtttgggagaagtgtggctattgtgagtattatatacttaacagttttgccaagttaaaggtttctcatcctttctacaaaaacggacatacagaatggtttaaatttacaagtgatgaatccagtctaatacggactgtagaatctattatttcaagtttaacatagaggaaaatatgattaaagtaactagactaaatgcggttacttcttggaaccgtgctttaaatgcagcacgcagaaccgtaggaaagtcagcattaaaaaaagaaccttcagactcatggaaagcaaaaatgttattggcagaacattctcctattcgtttggtagaatatgaatggacatgggagcaaatacctcaatgggtaacagtacattttactcgtcatcatataggctgtgaaaagtttgttcatactcaacgaccagaccgtaccggttcacaaattcccagaggagagcacttgcaaggagaattaaatgaaatggacatgaccgcaaatgcacaagaaataatggctatctcacgagtacgtttatgtaattgtgcttcaaaagaaactagagaagcatggacatcaatgttgcaagaactaaaaaagatagatccggtccttgttagtaagtgtgtgccaacatgtgtttatcgaggtttttgtccagaactaaaatgttgcggatatgccaatactcatcaattccatgaagctgttgaaaaatatagaaagactgaataattatgaaagtgcaaaaaagaacaggtcaaattgtagattttgacctagaaaaaataggaaatgcgataaaaaaagcctttgatagcaaacaagttgaatacgatccagcaattgtagaatcggttgataaatcaattagccttacctacactaatgttcccgtatctgtagaaaccattcaagattacgtagaacgcgcattaatgcaatttggatattatgatatagccaagacttttattctatatcgtgaacaacgtaaaagtacgcgttttgtcaaagaacgtattgattatatgaatcaatatagtcaatcaacagacaatgcagcttcttcatcagaaaccgatgggaatgctaatgtaactatgaaaaatgtagctaacttggaaggtgaagtctataaaactactaatcggattatccaacgccaacgtatgaaagatgagttgaacatcctctttccagaagtggcaaagcaatacgaaacagatcttgataatcatattatttatacacatgatgaagcatctacgccagtattaaaacaatattgtatggcagttagtttgtatccattactaacagaaggtgtaggcaatattgatggtgttactccttcagagcctaacgatttgcagtcgtttagtgggcaaataaccaacttgatattcttactttcttcccaatgtaaaggagcggtagccgtaggtgaatatttcattgcattaaattattatgtagttaaagagttcggagataaatggtatgaaaaactggactgcgaggcttcctcaccacattgcttaattaaaagaacagtacgtgataatatcctgaaagcgttcaaacagtttgtgtggggtgttaaccaaccagccggaaatcgtagctaccaaagcccatttacaaatatttcttattatgactatacatatttcacatctctctttggagaattttgttatccggatggaagtaagcctgaatggatagctattgatacattgcaacgtatgtttatgaaatggtttaatcaaatacgtttaaagcaagtattaacctttccggtagaaacttttgcgatggttcacaatggcgatgatataatcgacctaaattacaaacaactttgtgccgaaatgtatgcagaaggacattcgttctttacttatatttccgatagtgcagacagccttgcatcatgctgtaggcttagaaatgaattggcagaaaatacctttagccccacttctggcttgaccggtgttatgacaggtagttgtaatgtgattactttgaatatcaacagaatcgttcaagattgggcattgacccacacattaaatggaacacctttaattaagggtaaaaaacttataggtaatcccttacgtgtaacagtaattgaaaatgatttaaagaactatgtaactaggattttggaaagagtctataagtatcatattgctttcaagacaatgctatacgaccttgaagacaagggaatgtttgccgcttcaaatggcggttatattcatatcagtaaattatataacaccataggcatcaatgggttgaatgaagccgctagattcttgggaatgaaggtaagtaataacccggaatatattgaattccttcaactcattttgggcactattaaagaacaaaataaactgcattctatccatgacaggaaacgacctttcttgtttaattcagaagttgtgccagcagaaggactgggaggaaagaattataaatgggataaagaagatggatatgttgttccagaggatgagaatttatataactcatatttttacaatgcccatgatgacacttctatactagacaaatttatattacacgggtaccaaacctatcagtacactgatggaggttcggcagctcacattaatttggaagatcatttatcaaaagagcagtatctgaaattaattgattttgccatagccaatggaaccaattactttacctttaatataccaaacagcaaatgtgaagattgtggcaaaatcataaaaagacccattaatacttgcccttgttgtgatagccataatattactcaatatacacgagttatcggatatttacgcccaactaaagcatttggaagtgatcgacaacaagaggctagaaaccgtatatatagtgatggtaaatcccaggtatgaaatatgtagatacaaaaatagtgtttcaagaattgcctaatgaaattactttggcaataaatataagtggttgcccatgcgcctgcatcgggtgccactcttcttatctgtcacaggatataggagaatcattaacaaaagaagcacttcaacaattgatacgcaaaaataaaggaataacagctatatcatttatgggcggtgatgcaaacccggcatatataaataaattagccaaatatctttatcataactatcctaatttaaaaattggttggtattctggacgagataaattacccgaagagatcaaacttgatttctttcattatattaaattaggcccatatatatccagcaagggacctcttaataatccgaacactaaccaaagattatatcaagttgttaaaaaggggaatggtattaacctatttgatattacttctcttttttacaaataatcaatataataattaaatacatattatataactgtaatacaataatatatatttttattcaaaaaatatttttggttttattttgatagttaaattgatacaattatctttgcagtgttctttgaaaaacaacagtatgttgcatggtcaagcacgtcttattgtgcaagacaataaggcagcaaaacaagagattgaattggctattggaaatttgaaagatggtgattatactattcttattatggacgataccaaaaacaaatctctaccgcaattgaagtatctatttggcgtagtactgaagacaatttcagaacaattgcctacacacccgccagtagatgccctatacagatattttgaggaaatttatgctccgattcatgtctgtgatcttcctggaggtgaaaagtatgaatactttaacctcaaaaatgaaaaagcaagtgagatgaatgaagttattgagagaatcattcatcatgtaaacactgaatggggtattaaggttatgttgaaagataaaaccaaaatgccagaagcaaaagaactttgggctggagcttataccgaacagtggaatcttcccctctctaaattaaacaaataattttcattttatggaagagatgattaaaaatccgtatgccctctttgcggagaatcaagaaacttatgaagaggcggtaaaaaagagtaccgatgagagccaatcatttcaacgtaccaaacatttccgtatggattccgcaggaacttatactgtgcgtatccttcccttggcaccaaccgagcaaccagacggctcttacaaattagaacgtaaggggtacgaatatccggtcaaaacacaggtgttgaaactggacaacccacgtccaacaggaaaaaaagacaaacagttctttgtaaatatctgtcattccagctatgccggattatctgtagacctaattgacacttatcttcaagttgcagaaaacaagtatggcagtgatgaaaagttgatgaaaaagattaaaggttcaggctttgatggtggtctaaaatggaactctcaacgtgccatgtatattttagatttggacaaccgtgaagaaggtattcatttacttatcctgtcttattcgcaatacaaagacttggaggatcgcaaactggctatatggaagaaacttctggaaaaaaatcctaaatgtttgtgtcccatctcttctttggaagatgctttcccggtagaaattactcgtaaagaggaaaacaagaaaaccacttacacattcaacattgatacaatttccggtgccgaacctctatctgaagaggaagtcagttcgttgttggaaacacagcgtatcccagctgctatttatcgttactcacgtttccacatggaggctaccattgagttcttgaagcaatacgatgctaaaatggaaatggatgtaatgagcagcaaagagatcacagaagctattgaaaagattaaaatggagcttcatcctgatgataaatcccatttctcttttgacaaaaaagaacgtaacagcggtgataatgaggaaccatcagacaacgaactggattcattgtggaacctctgggaaaaactaaatgaacgcggtattggtgataagagcgaagaagggcaagacttacgtgatgcaattcgcgaatatattgatgccaatgagctaaatgtccgtgtcactcgtggaaaaacaaatgaagatttgctgaatgacattgaagacgcgttggaagttgctaaagatggcagcaacaacgaagatgacggtacacaaagcgatactaaaccggaagacacgcctttagagccagaaccggaagaggaaccagaaccaacccccgctcccactcatgctgttcgtagacgtggtgaacataatgatgacaccaatgagccggctgcaaacccagttcgtgaacgcagagctgcacgtcctgaacgtagaagaagataattcatttttgtattagcattatagggacatatctaactaatattaatatgtccctatttaaattgaatcacaatgagcaagaaaataccaagtgccttattgttgaatgatatacatgtatcaaaagacaatattccagaatttcaaaaaaactgggacgaggctttatatatatgcgatcaatatgggattgaagatatgataattggtggagatttgtggttatcacgctcttctcaaacacttagcacactcatggctgttcgccaagctatcataaaagccactaaagccggaataaccattaccgttgccgaaggaaatcattgtaaagttgaccaggaatcagttctagggtatagtcatttgtttagtgaatacccccacgtctatgttgttgatgactattcgattattaatattagcaacgatgtagaactatatataatgagctattttccagaaaacggaagtttcgtagaacggctgaaaaaaatggtaaaggcggaattgaacgcgtctgtacataatatcctatatattcacgaaggaataaacggggcacttagcacgcctaatgaaaaagaactgcccacgaacattttcagtgattttgatacagttcttgtaggacattatcacaatcgttgtattatcaaaggtaccaacattgaatacataggttcttccaggcaacataattttggcgaagatgaagaaaagggctataccattatatatgatgatggtagccatgaattcataaagaaccaagttaatattcgctacaaagttttggacataaaagctagtcaaatcaattcaaagctaattgataaactggatgacatgaaagcggatggaagatacaagattaaaacaagaatcagttgtacaagccaagaagcttcaagtattgataaacaaaaacttctggaagcagggtcttcaaaagtggaaattgttactgaagatgtggaaatcacagaaacaacagcccactctttagataaaaaattcgacaaatccggtattaagcaagaatataccagtttttgtgctaacaaaggaatcataaatatagaaatggggttgcaataccttgataaaatcagttaatatgtggacattaagacaagtttacgcaaaaaacctatgtgcttttaagcaattggactatacattgttgcaaaaacatacaacgctgatttttggcaacaatatggataatgattcgcaaggttcaaatggttccggaaaatctgctatgctagaagcaatcgctattgggataaccggagagacacttcgtagaataaaaatggatgagataatcaatgatgcggaggatgaagcgactgtttcccttttgtttcaaaacaatactacaggacagtacttatctattaaacgtgttatctcccgtaaaacagcacagataatcaaagtttctatatattatgatgaaattgattgtaacataaaacatatagaacaagccggagttgcagattacaataaatttatacttgaaacactggggctgacaaaagatgatgttttctcaaacttcattctttctaagcacaaatattcgtcatttctttccagttctgatcgcgagaaaaaagaaatcattaatcgtttcagtaacggtgtaatggtagatgaatctatcgctgcattacaagaggatatgataccgattcaagaatcattaaaacaagcagaattgaatgtagcaaatcataccggacgtgttgaaacattacaagagcaaatcaacacagctattacagaatcaacagagcgttcacaaaagaaagctgaacgtatagcaaactggaatgaagctattgctgggaaaagagcttatatccgtgagcaaaatgttctcataaataaaagtgacgagttactggaacaatatgataaaacagatgaagtattgcaaaaactggaaaacagtaaaaaggataccggtgcatgttttgaaattatttcagaacgttttacttcatgcgctttgccattacctaaggattttgcagctatatcaattaaaaatcagaaagaattggaggttgttacaacagaatattccaatgtacaacaacagctgattcagcatgagaaaaagattgcaacagccaaatcctcttatgagaagctgttaaaacaacatgagaagtttcaagaaaacttcaaaaagaaatccaccaaaattgagaatcaaataaatgaattattggattctattaaaaagttggatgccgagaatagtaatcttagatcacaaaggactaagttggaagcagatatagccagcctccaaaaacaacttgccggagttatcgtttgtcctaaatgccaacatgaattcacattggctaatgatgtagatataaacgaggttaaactaagattgcaagaccgaaatggagagacacaagacattctccaaaatattgaggctaatgaaaaacgcattttagatattacaacaaaaggacgcgaagctcgtaaagaacaggatgaattgaatcgtagtaaaatagaatggtcgaataagattaccgaaacttgtacggcattggatgaattatcacgtaatacgtcttatttaaccaataaaatgcaaaccctccagcatcaaatgaatacccttcagaaatccattgatgatgcgcgtactaatttatttgatgattcttatgcaatattagatgaagctattagaaagcaagaatacgaagcaaagcaggccgagttgaatattaacaatgctaatggagctattcagtcatacgaagaatctattcgtgacattgaaaactcttccgaaactgacatgatagaatctctcaaagccaacaagaaaaaatatgaaaaagaattggtattagccatttctgaaaaagagactattgaacggaaattaaattcatataaagagcaagaagcaacctttactgaatttaaaacccatctggctaatactaaaattgacgctcttagtcacataactaacgagtttctggaagccattggtagtgacattcgtattgcattttccggttttacaatcttaaaaagcggaaaaatcagagataagatttccatttctcttattcgcgatggtgtagattgtggctcttttgataaattttcagaaggtgaaaaagcaagagttaatctagctaatattttggcaatgcacaaacttaccaatgtaaattgcgatgacgataaaggactagatctcctgatacttgatgaaatattagaagccactgacgaacaagggctttccaacatttttgatgccctcaatcaattacagattacatctttggtagtcagtcatggaaatatagctgaaggctacccatacaagactgtagtcaataaacttaatggcgtttcatacatagaatgattaacgaatcaaaaaacattaaaaatgagtcaataaatcaaattacacgtgataatgtgcttgcattagatatagcagagcactgtggatattactcaacccatgaatcaggaacatggaattttacccaaagaaaaggcaaaaatgcgaccgagcaacataaaatgttttatgacacactggttgaatttatccaaaaatacaacatcaaattgattatcgccgaagatgtatgcgtttcaaagcatttcattgcagcgcgaaaactatccgaatttagaggcatattatatctgatatgcgcccagcttggactcccggaaccaaaattcataaacgttagcacagtaaaaaaatgggctaccggtgacggaaaagctgacaaaaagaagatgattgaatattgcatcaaacgatggaatattacaccagtcgatgacaacatggctgatgcaacccacatcttcaaatattatgtaagaatatacaaactttagacagaaaatgagttacgcaagaaacataaggcgtaggcaacaaagagaaggccagccccatttaatgatgctaggaagcttgctaggagatttttacgaattccttagtaaacaaccccagccaacagacaacgaggtaagaagtaattttatctctagtaataataagtggaagaagtattgtaaagtccacaaattgatgaactcggatcacttgtttgtgctcaatgttcaagaggcgtggaagagacatactcagcagttaccacagaacccataataataagtgatgaagtagctgcacggcgaaaagccctatttgataaatacgtaacaccgtacaaccgaatgatatacaagttatgtatgcgctatacttttaatccttctgacatagaagacaattacatagaagtgcttaccaacatgtataaatatatcgagacatataatccagagcgttctgtacaaacatggctccatattgtaaccaaacgatgtgtttttgatttggatcaacgtaaaaaaaggcatcaagacatgttgagtgatgataacgatgtggaaacattttcttccagtgaatctattgtagattttgacgaagtaagctctaacgtaatgggtattgacaattatcaagagttatacagcgatgatgttttagctgcattaaaacagttgaaaccacaatacagaagcgcacttttgtatcaacaggcaggatataaactcaaagaaattgccgaaatcgaatatcggaacggtgccttagaatctcgcaatatcgaaactgtcaaaagtcgattattcttggcgcgtcaacaacttcaacaactattgactcgtgatggaaaaagaagaacgactgacgaaacagattaagacagtatatacagaaatagccaagcgtttggtagacccctccttctcattcccagagggagggcaagccaaacgccaactatccaaatttattgtcaactttactcaaatttgtggtggagaatttaatacttcacgacttgtagactattgtgtattccagcttcataaaaacaggaatgcccaatatcaacgtacattagctccaaaaacatttgggactaccgctcttcaaaaatatctatcaatgtcttccaaatccaagcaatatctggaagaccaatggttatctgaagccaatctaaccagagcctatctaaattcactaatctgtaaaaaagagcatcctcagtctaagtatatttatatgccatctgaggaatgcactaagaaacggagtatcaacacagatattgggtttctaatatgctctacatccacattgatgtggagtccattctctccagcatgtcaaatatgcacaaatgtcgagaaatgcaagcaagaaaccgcgataaaatatccagagttataccgaataagactcgaagaatatggcgaaagaagataacgtattaacagaagatttcttatttgaattatattacgcttgttttacatacgactatgtatgtagcttagtgtgtgaatatatgcagaaatcgtacctgcctggtagagattttcaagcattgcaggggtatctgtgcaaatacttcgcagaacacaaatcatcccctacccttaatattatcagccagatagtttctgtcaacagagaggtttcagcactgttagaagatataaaagactgcgccgaaggagttgagccggaaattatattggaacagtttgaaaattatctaagacaagtaaaatttcaaaagacttacaaagagataggtgaactctatgcaaaacaggatcgtgacaaagcaatgaagttgctccaatcatttgcagaatggcaaaatgatttcagcttgcgtcaaaactcttttgttgatgtagtcgaaacctttgaatcccgttttaggcgtaatagagaaaaacacaatcaagagtcaagatttaaaccaatcaccagattttatattgatggtctggacgaaatgaacggtggacgagatttacgtactcaattaacatgtctcttagcccctactggtgttgggaaaagtcatgccgcacgttggattgggaaatgcgcctctcaaatagatggattaaacgtacttcatttccagttagaaggttctgaagatgaagttgtggatgcttatgccgcgtcactggtttcctgtaattcttatcgttatagtactggtacactaaaagatcgggaattagaacgaatgatacaagaaattaaagcaatgtctggcaccctaaaagtcaaatcctttccaaagttcgctaatcaagtgtctaccattgatataaaaaatggtattgctgaatacaaaaaaatctatggcatatctccagacgttgttatcatagattctatggatttgctaacagattccagcggacgtagatggtcagaaaatggagaacgccacaaacgagttgctgtagctaatgatttaaaggacttggcaggtgacgaaaatgtctggatggttgtgacttatcaggcaactatagaaaatagagagtggcttaacgatgaacaaaatgtattgactgaatataattgttcagaagccaaaggtttgagcagaccaatgactcatcttattactcttaatcaaagcatcaatgaaatgcgcgaaaatgtcatgcgcctaaatgttgcaaaatcacgattcttcaaaaaaggagacccatttaaaattgctactgattatgataacgaatgtttttatgacagagcaagaacattaaatatcagcaaagttgcgtaatatggaattgagtaaagaagaaaaagagtatataatccaagaactttctattgaactacatgcaaaaccggatggtagcggaaagaacttgattgtcccccagtgcccctattgtgggcatgaaggggggaaatacggtatatatataggtaaagcaaccgaaaggaaaaagccttttatggcacactgcttttcgtgtggacgttcaacccagacattagagcaattgctaacagatataggccgtcaggacttaattataacagatacttttgatcttgatggagataaaaaaattaatgatttctcttttctggaaaacgatgacagggaaatagatgactctctgtgtgttgtggaaatgcctgaatattataagcgcactcattttaatcggtatttaagaaaacgtggatttactgaagaagattacgatttctttccagttggcactacacgtaacatgaacttcaagtttgatgattatgtaatatttccgattatagacaatggagatattgttgggtatatttcccggcatatttgggataaagctgatattgatgaatacaaccgtaaagcaagtcataatggaaaattccaaattatgcgttataggaatagcactgaaaacgattttgttaaattattatacaactatgatagtataattgaagacgaaacagataccgtaattcttgtagaaggagtgtttgatgtcattgcacttacgcgaaaattaaacctgtataataacccatctgtggctgttgttgctacgttcgggaagaaaatctctgatacacaaatttataagttacaggcaaaaggggttcatacaatagtcattggatatgatggagacgctacagaagctataaaaaagacaggtgatcaactaaatgaatattttgattgctatgttgccgatatagaagattccagccaagatttcgacagcatggacttttgggagatatatgacacattcgctttcggactgaaaactttaaccgaatataaattaaacaaaattcaaatatgaatcctgatttattaaattggctagataataataagatgtgtttcaatatcatagatgaagatgttattgaaatcacgggctttggtaaaatgtactatgaagataccagtatgattaagtccatcttccgtactgatgctgacaacaacatcaagttcaatacaatggaaaacatccaaacattacaagaagaaggcattaattatatagtatttcaatttggagacaactggtattattacgatataagaaaagattttgaatttcaaattttaaagtatgtaggcgataggaagccattaaaccatgcccaagaatttgtaaacttaggcatacataccccttttgaattgctcaatggaagtttctcgctaacagattggataaaaaaagccaaatacttagggcaatccgcattaggtatttgcgattacaatacaatggcagcaacccttattcttcaaaaagaatgtgaagctgctggcatccaatgggtgtttggatattcacttacattcactgatggtatcgaaaagatagatgccaaaatatactgtcagtcacaagaaggacttcaaaatttgcttagaattcaaaaatgtattaatgtagattctgaaaataaaatcattgatttacaagatcttctaaaacatggaaccggtaatataattgtatttagcaaatacgcgtcattttggttgaaagaaataggaaataatcttgaccgttttttcgatagttttgacgattgcttttatcaattagatttatcggaattcaaagctgaacgtattgatattaaagtactagatgccacaaaatgttactttgactacatttatgatacaggcgatcttcctccagtattaatttgtgactgctattatttggacaaagatgatgcaaaaaacaaaatcatccttaacaaaattgctgaaggggcagcacatgaacaaagtgatgaccaatattttaaggacttggacgaacattggactactatctctggcttgtttgatgaacacaaatgggacatagaggatatattcaattgggcgtgtgaaaatacagtcaaaattactgaaggggcaaaagctagatatgaaattgaacgcaactttatgcctcaatatgacatggctgacaatgaaaaatcaaagtacgccaaccgacatgaaatgtttttggatttgctggaagatgggttcaacaaactggtccccaaaggtaaagaagatatatatcgcaaacaattagattatgagatttatgtattggaatcaaccaacaacgtagattacatgctcgtacaatatgatactgttaattgggcacgcaaaaatggaatattagtgggatgcggacgtggttctgctggagggtgtctagttttatacctattgggaataacacttatagatccaataaaatacgatttgttatttgaacgcttccttcttccagaacgtgccggactatacccttcagatgtaaccattattggagatgacgtagattccaatcaatatatcgaagttacattagaaaatcataaaacttataaaatagacaaagatgcacagttacttgtgaaacgtgccggaatggatgatcctattgtagtatatgcagatgaactgcaaactgacgatgatattcaatttgataatcgagatcttttatttactctaaacgaaatttgattatgattccaattttaagaaaagtgggatgggatttaaatcccaatgacaaggtagttaatgccatcctcaaaagatgtgaagccaataatggcgagtgtccatgccacaatgactccaaagacaaacgatgtccgtgcagctcgtatagagaacatgatgtttgtcattgcaatttatatgtaaaaatcgaaaaataaaaaggtatggaagatatgattttgacagaagagatgcaaaaaataatgaatctcattcaggatgatgagaataatgtattcgtaacaggtaaagccggttctggaaagactacatttctaaaatatctaattgaaaaatccgggaagaattgcattgtagctgccccaacaggcatagcagcgattaatgcagggggcgttacattgcatagtctatttggcattccttttggacccattacaccttacgaccgactggaaaacaaattttcagaatacaaggtagaactattgctcaaaatggaattgctgattattgatgaaataagcatggtacgcccagatattctggacaccattgatcgcaaactaaggtgggtttacgaaagcgatgaaccatttggcggtgtacaagtggtaatgtttggcgatctttttcagttgcctccagtaacaaagaaacaagaaagagaaatattgtctgacttttatgatggctttttctttttcaacgccttagttttcaaacgcacaggtttccacattgtagagctaacaaaaatattcaggcaaacagaacctgaatttattaatgtactcaacaatattcgtaattaccaggtaacatccgatgaactggatttattaagcgaattgaaagaccgcaaaatcagtagcagttatgataacgaatacatccatatttgtacacacaaagctgatgttgagaaaattaatgccgacaaattaggggaacaagagatacgaaactatgatatagttatcaaggataagttcccagaatcatctataccatgtgatttacatttaaaacttcgagttggggcaagagttatgtcattggtaaacgactcattaaagggttattataatggtatgcttggaattgtgaccgcattagaagataacgtaattacagtacgtatggataatggccggactatcaaatttgagcgttatacatggagtaatacgcaatatactttaaaagataatgagattgtaaaagaagaaattggttcatgtactcaattcccattaacattggcatgggccattaccattcataaaagccaaggacttacattcgataaaattatcattcatgtatcacatactttttgtcctggacaactatatgtagcccttagccgatgtagaacgctggaaggcatcgtttcagatgcttttatcaccaaacaaatgattattccagaatatgctctaattgattttgaaagggcatacaaatcagaaggtaactattatggtaaacggttagattaattaaaaatgaaagtcatatcagttaaatataaaacatcttcaacagaggtgaaagccatagattgttttgtggacagtggttatttgcaaggtcctggaggttcccttccagatgtggatgtagacttccaatcagaccgtagacaagaagtaaaagagtatattgaacgccgttataaccatgatggtaaacaacgtgtattttctgccggaacctttacgactttaaagttgaaagcagttcttaaagatgtagcgcgtgtacatcgagtaccggtaaatattgtaaattatatcacagctatatttgaagatgacaatatgagctggacagacctgtttacaatggctgctactaataaaaaggtacatagcttcataatggaatacccacaagtaattgaagatattcgtactttgatggggcaacctcgttcttcatcagttcatgcctctgccctactagtaaccccagattcaaaagatggaaaagatttggagtgctttgattttacccctataaagaaaatagacggtgtattgatttccgaatttgacggttattcattagacgaacagggattactaaaaaatgattgtcttggtatcaaggaattatcaaaactacaagctgtcatcaatatatgtaatgataaatatcataccaatattacttttcaaaatatcgtgcaaagcggactagatgatcctaaagtatatcaactactacaaaagggatatacccaaaatattttccagttttcatctaaagggatgactaagtttctggtaagtatgcaaccagataaaattgaagatttaatcgcagccaatgccttatttcgtccagcaacactagattccggatctacagataaatatgtagactgcaaattgggagatgcagatcctgtatatctatggggaacatacaatgccatgaagaatacttatggtgtgctgtgttaccaggaacagctagcacaaattgcacgtgaagttggaaaattcagtttaggtgaaggtgttaaattggtaaaacttatatccaagaaaaaagtagataagattcttgccttacgagacaagtttatgaccggagctaatgaaaatggttgcccaaaagaagatgcagaagcaatatggcacatgtttgaggtagctggtggttatctttttaacaaaagtcatgcaaccgcttacgctgttaccgcctatgccggagcctacctcaaagccaattaccctacagctttttataccatagctcttcaatgggctaaagatgatgaaattcctacattaatgagtgagatggaactatgcagtgaagcaaaaatagttccaccagatataaatgtaagtggcggaacctttattacagactatgaaaccaataaaattttttggtctctttctcgtattaaaatgttgggagctaaagctacagaatggattataaacgaacgaaatgtacgcggagaatttagttctattgaaaactttatagaacgaatattccggtataaattaaagcagtacaaatattgggatgatccagacaacccgaatgaagttactaaatgcccagttaatgcaagacatgtccgtcatttaatattatccggatgttttgacaaagtagaaaatgcccaatcagtcatagaacgatatgccattttagaaaaagccgcaaaatgtttaggttttgaaatatccgaaaaagatataccggaagatttgagaaacaaacattatttctggagtcaacagcaaatcgcaattagtggcattggagctatcgactataaacgtatttatgacaattcagaagcaaagcccaaaataaaaggaaaagcatcttgggcacttttaaaaaacatacaagaccccgattatgatggaaaacgcgttgctatttgtgctaacattgtagatattgaggagaaaaagtttaaagacaagaaaacaggtgagaatcgagttttctgcaaacttttacttcaacaaaacaatgatctggtagaaatggtcatctggaatgatgaatggatgaatgtccgggcaacactttgtaagggtggttctcttagcagtgcaaagagcaaaatgcttatatgttccgcccaagtcaagtacagtgactatacaggtggaaacaatcttcagttatataaatcttcaattatagacatattatgaaaataaaagcaaatataccaattattataactattgtcggaccatctggaagcggtaagacaacaatggcaaacatcatgtctgaaaacggcattccaacaatagtatcatatacaacacgtcccatgagggaagaagaaacaaatggaaaagaacattggtttgtaactccggaagacaagccccaaatgtctgaaatgatagcttatacacaattcggcgaacatgaatattgggctacattgcaacaggcaaagcagaagatatgtacatacgtaattgatgaaaaaggtctgaaatatttaaaagagaaatttccaaactcatttattatattttctgtatatatcgacagaagtatggatgatcgtataaattgtggaatcgaccaacagcgatgtgaacgcgatttgaatcgtatagagatacctttaaatgaatatgattatgttattcataataattattcactcgaagaatttaaacaaaaagttaaacaactcacactaagtttattaaaataatatggcaactcctaataacgaaaagccaattatcgtggcttttaccttagactttgagactggcggtttggactgccaagattgcgcatgtacccagattgcaatccatgcagtacgtatagatacttttgaaacaattgacagatatgtaaaatacatatccccatataataaacagccggataaaggtgtggctaaacgtaaagtattgaagagtaaatttgataaagacgatgaacagcccatgaaatatgaagaaaaagctctgacttattccgccataacaatggatatgttagaatctcttggtatggacatcaagcaagttgcggcagaggttattgattttatccgcaaaaacatattatcaaaaggtcgcaacataaaacccttcttaattggtcaaaacattggatttgatataggattcatgcaacagttaatggaatatggaggacaaatgaaagaatttgccaaattaatgagaggagaaacagatttctatgggcacttccagcctttatatatagacacaatcgttttaggacaattggctttatctcatttagatggcatgagcagttataaattggaaatcatggcagaaaaatttggtatcgaactagatgatgcccatgatgcagatgctgatgtaacagcaacgaccaatgtggctatggtatgttcccaaaggatgcgtaatgcttccggcatagatgatggtagtatggttatgaccaaaacagaaaaatcacgtgttcatttcaaaatataaaatatggtaacagaagaagaaaagcaacaagcgcaatcaattggactggagccagaagtagtgttcaacactctttcagaccgaagaattctggctgtacaaaccgaagatacccatgaaactattatggaaatttctggatatgatttacaaataaattttaatcgggacaagttacagaacattgcagatatagaaagtatgctagatggtctcaaagacctattcagacgggttgtcatgcaagatttattagaaagtaatgttgaaaaaacaaactcataaagcctttcatagctattcttagtaaaccaagcccagttgaacatatcggctgggctttaatacaattaaagaatggaactaaagaaaccagaatcgttgaataaacaagaaattgatttttgtgagctgttcattttcggctgtgacccttatgctggaaatgctcgcaaatgctacgaagatatattctatgattccagtcatacctctttaagaaaggcaaaacaattaatggcgcgggatgatgtacaagagtatatcaatcagttgcgagctatcgcaaattatgaaacagccgatctaaaagctcgtctaacagaaaaactattgcatattatagacgaaacttctacagcaaaatatacagatcgaagaggcacagagctatcaccagctccattacgttctgtagctgtgcaagcatcaaaagctttaatggaaatgtatccagtaaaggtagcacaagaaagtaaagttgaattgaaaggtaacggtgactctggtattgttttcaatgtcattgttcctcaatctaataatgataataatgttgaataaaagaacaaatggtaggacgaaaaattacaatcattgcctcccctttattgaaagaatggaaattgaaaaagttaattggaagggacggggttattattaaagagaatcaaaatcaaaaaacaaaaggcgtatgggtacgcttaaatgagccatttgcaaatgagctagaatggtttatcccaatccaatcagtacaaattacttcacattaatatggaacagttggataaaggcatcggatggcttcagaaattgcttaacctacaaaagagatatggttttttcagcattataaaaggactatttctgctgtttttaagcggttacatcatatttttcgcattaaatccaaagtatcttttggatcgcatgtccgaaataacaactgcccaacatgaccatctagtaaatacaaggttatctgcggattccaatattcgccatattttatctaaaatgatatttaccactaatgctgaccgggcatggttaatagaatttcataatggaagtaaaaatctgacaacaggattgccattccttttcggttcgatgcgaattgaagaagttagggatagtatatcaaacgttgacgaagactatgcggattttagcttatcaaaatacaaacttgtggcaaaagtattggacgatggatatttttatggtgggttggatgatattcaaaaaatagaccaacgcttgtattacaaatttcaagccaacgacattagcgaaatagccttattaacattgtatgatggagaaaagcccgctggaattattggtctatcgttttgtaacggtaaaaagatggacaaacaactagttggaaaacatatcagaagcagtggcataaaagtagccacattactgtcacaaataaatgattaagactatggaattaagattagaacgtctatggccaaaagagacttatacaattggcagactatatattaacaatgagtttttctgtaatacactagaagacaaaatagttgataaaaataaaaatggaatattcgataatggagaaaaaaaagtttatggagagtcggcaattccgtatggtacttataagataatctataactggtctccaaaattcggtcgtaatctcccaagattattaaacgttcctcattttgaaggtattctcatacatagtggcaatactgccgcagacagtgccggttgtattttagtgggaaaaaattcagcggtaggtcgattatctgaatcaagatatacttctgattgccttaacaaaaagattgaagaggcacaaaaaagaggggaaccaattactatcagtattgtatgaaaccaattactatcataagttgtattctttgtattctgttactcggttcatgcgctacttctaaaaatatggagcatcaacaacagatagattactccagtgaattgcgacaactccgcaactcactggattctcttcacatggatattgacaaacaatctaaagtaacggcagacaaattgagtaatttgaagttagaaaataaaactgtgtatttgtcaatgccagactctaccggaaaacaatatccaataaaacaaagcacaactaatataaacaaacaagataccgagcatacagaatcagctgaaacattatcaatatccatatcacaaatatcatccaagctagactctctataccaaagggttgatgaacttagcaaatcatcaggaaagactatagaattaagttggtgggatttacataaagataagatttatctatcggcaataattacaatgctaataacaatatttcttgttaaaatcaaaaaatcatatcatttataacaaccacctctatagcaaaagactattcttgataaaacattaagaagttatggatttacatattaaagatagattgcttattccttctatttttccagaacggggaaattttatggattttaatttgaaaaagtctatcgcccggaaaattgctatttcagagcaagacagaaaggactatgaaatagtcgaaaaaaaggaagaaaagcgaattgaatggaacgttcaaaaagacgcagaaaccccattagtggtagaattttctaaagaagaactggattatatgcgtaggtcttgtgaagctattgcagaacaacaaatgccagatgaaatgtgggctgtagttgaacgcatctataacgaagcacaaaattgatttcttacttctttactcacaatcatatcttccatacaaatgggaatctgtcttactgtacggattcccatttattgttttaaattaacaatatggctgtaggattaaaagcaccaaacataaaaattgatttcaagccatctcccaaacaatatgaattatggaaattacttcaacccgactattgccctcattgtggagggcatatatcacaaaaaatggtcggacatgatattaaaggaaacccacaatataaaccatattgcacatcatgcggctctgagaatctaccacaacttattttaggaggcggtgcagccggaggtggaaaatcttacttaggaagttgctggcttgttagtagctgcatgagatttccagatatacgtgccgttgtagctcgtaaaaccttaaagagtctaaaaggttctacttggaataccataaagaaagtgtgtaaggaatgggggctaaaagaaggggtaaattacaaaataaacaatctggatgggatattgacattttggaatgattcagtcattatcatgcaagaaatggttgacttaccttcagaccctaactttgaacgtttcgggtcttcagaatatactattgcattcatagatgaggtatcagaaatttcagaaagagctattgaagtattattttctcgtcttcgttggcgcacagcagaaacatttaagactgccagaatgatgatgtcaaccaacccttgtattaattgggtacgttcgcgttttgtacaagacgatgaaggaaatcctgtattatgcaaagaaggtgaagcatacgtaccattctctgtttttgataatccggatattcagtttgtacagacctatgtcgctgccttaaacaaaattacggatcgagcaacacgagaaaggcttttatatggaaactgggattttgttgactcaaatcttatggctgcatattggaattttgatggcgaaaaacatcttattgaacggttacgggaaaaagtttatgatccgatgaaaccaatcatatcaggatgggactttaatgtcgctccatatatgagtgagatggagttgcagattaattatgagaagaaagaaatatatctgctggaagaaaatttaggtaaaccagagaacaaagaaaacaataccccaaaattatctcaaaaaataagggacaaacacctccagaatcagcatataggtggaataattataacaggagacccagcaggattagcacgtagcacgcaaacagaagaaggtgtcaacaactatactattatagtggacaatatgaaaaataatgtgctaaggccacgtataaaattgcttcagaagcagccgccacaaagtaccaggttggagtttgtcaatgcaatattaaacgggtttgacggttggaaattcatggcagacctacggtgtcgtaaatttactgaagatatgatataccagcagaagaactctgacggcaccaaatccaagaaaaaagtattaaaccccaaaacgggtggaaaagaagaaaaatacgggcacttatcggacatcttggattatgtattggtattgtttctctgcgactcatggagacggttccaaaatcaaaagacaacaattgaaacatatacagcaccagtctataacacttttgaatattaattatgtatagaaggtttttaaacaaaaacgattatctgggtatcattacggaggatgctttatcgcagcttacccgtgggaaagatatttgttttgtgcaggcagaacaagccgctgaagcatctattatggattaccttactgaaaattacgaaattgaacgcgaactaaatcgaggtaaattcatctttgaatatgatcgaagaatcagttatcctataggatgtcatttttaccttgacggagaaatatgcgaggtaattcaagctatcaatggctacaaagctccttgtcctatatcttattggcacgaaacagaagagatacttgacttggaaaaaatagaacaatacagccagatgaaaaactatcgtcccggagatgtgataaagttcttaggacgggcatatatatgtgacatcgccaatggcatagacttcaacgatattcgtattccggaagttaatgcctgggaaatggttgatacatacaagtgggacaccgttccatacaatgaatgggaagttgtagaatatgaaggcaaattcttcaccttgctaacaatggataattatgactgtctggtcaatccgatggagtctgactgctgggggatgattggagaatatgacccttcactcaattcttatgagttgtcagaacacgaatatgtagaatataaaggaaaaatttattatcctataatcaatcccaatgctgatgtaccggaactggaaaggaatatcagataccatgacccaagaaactataacttgaaacgtcacatggttcaactgtcattatacgagttgcacaaactgatttctcctaacaatatcagtactgtacgaatagatgactacgaccattctatgcaatggctaaaagacgcttccaggctaaaattaaatcctcaaattccgagaaaaattgataacaagaaagagcctcttacagactggcagatggcaacctttcaaacatcttatgacccatatcaaaatccttggcatgtatgaaacggttttaatatgacaacagaatctcaaaattaaaaattaacctcaaaaattacatggatcttctaaaaagaattaggcagaaaatagatgaattctgctttaaccacatgagaatggacggtgcccagcatctgattgccggcatcttgatttatgatgtactcaaataccttatacctgtttggagtgccatactaatcactctgattatacttgtcgccaaagaagttgttttagacaaatggataaggaaaggagtagctgattggcatgatataatctggggagtcataggacttctgttaggagtgctgtaagtactactcttagactaaatgatacggtgggtaatagtgatattgctcaccgtattcttgttaatgatgctgtagatactgaacttacttctattaattgtgttaaaagtagtgctgataaagataattttaatgatgctgaaagaaaaagtaaaactaatgttgtatctttgcacaattaaataaataatgaacaatatcataatgctaaataaatcctatttaagtatcacagatacaggattttattaaattagaaaattatgaacaactctaaaattggaaatttattagcttacatttcatctaaaattgaagatattaatcttagaaaactaataaaattagtcttcttaatagatgaagagtcagtgcgttcacgaggtatatctgttacttggctaacatactatgcttgggagaaaggacctgtagccccttgtatttatgagattaaggatagagggggaattttctctaaatacattagtgttcacagaaacagagaagaaaaagtaattattaccccatttgtagataaaaacgaaagttcaattcaatttagtaagaaagaattgagacttatagattctattattgacaaatacggacaattatctgctgatgacttatcagagataacacataaacctggaggattatgggatattgccaaaaagaaatataatcctaattttaaatcttccaatgggcgttctgatataaaattaaatttaaaggatttaatagagggagatgaagaaaagataagcgtttacaatgacgcttatgaaattgctattatgtgttaatgtaataaagatgttatcaccaagaaatgtagtttacggctttagtaaaatcacaaaccctccaaaggaaaagtatttaatatctttatatagaagcaaagaattaagtgtagtggcatgttttactacatcacaagatcgtgcaggagtaccgttggagcaggtaacacatggagcgattaaaaacaaagaaaaagaaattatttcttatgtattcttgaccagtgtgtgtgtaggagtagcaccagatggcagtgattatcatttcccggttcaaacggttgttcgatttgactattgctttaaagacggggagcaaacagaccttttatcaagcttcaactctcctaaagtagtttgtaaattgaatgatgctgaatatgagaatctaatatatgcaatgtataagagtgatgatacacccgaaaaatataaacctcattttgagaaggttttatttgatttgggagaaaagaaaaaggctacttcatagtagcctttcttttttatcttcttttcatctgtacaaaatcaattaagtcttgttcattaatcagtattttctcggtaggcttagtatatgggattctcccatctgccaaatacctctgaacggccctgtaagacgagcgtaggtattccgcagctttaatattgaaatgcatattttataataaaccccggtcacttagggtgaataccatgtgtcaaaacagtaatctgggcttttacctattttggtaagtcataaatgacacacagtgcaaagtaaccgaggcatatatttttatctattcgtcatattgacgaagttcatcaagtcttgctcctttatcaatactctaccggctggcttggtgtacggtattcttccttcagccaagtatcgttgagctgttctgtaagatatacgaagaaaatcagctgcttctcttacagtgacaagtttcatcttcatacaatattgttaagtcgttcaaactctttgtctacttcagcctggtatatatgcgcatatagctgcgtagtctggatattcgtatgtccaagcattttgctgataacctcaatcctcacaccattggctaatgcaacagtagtggcaaaggtatgccgggcaacgtgactcgtcagcttcttctttatttcacagaacgcccccagaatttttaaatatgaattgtacttctggttagatataacaggcaacttaaactcatacttctttaatatattcatgactttatccatgagtgatatattataaggagttccggtttttattctctcatctcgtattctatacattccgtctgtcattatagcatctttgaagttgaaaattgccaaatccgcataggccaaaccagtatagcaacaaaacaggaaaagatctctcacacgattcaggcacatatcatcaatctgtttagtttcaagtttagtcagttcttctttagtcaagaactttcttgctacacgtttgccgcgatctaatttgaaattctgatatggattctctgaaatcaaatgagccgcgtatgcttctcttacaaacactttcagtatcttgtgataattatataccgaagactggcatttgcatcgttttttggcgaattcatcgtatgctctgatattttcatcacaaatatcagtaaaatctttaatcctgccaaattctttcagtgcttttagtacacacttctgcctttgcttcgttgaatcagtaacttgccgttcgtatatccgcttctccataaaggacagaaatgaatttgtggttccggattccgaattgttcaaataccgttccaatctttcaaaggtgaaaggaatgttttgagaagaaagctgatagacaaaatcatatatcccagacaccatatcattcaacttttggttgaacactaatgactgggggtgatttttaactttcaggtctttgccccactggtcggaatagagttttatgccagttccgacatacttgcgtttccgctgataagtaacctccatttgtacggaggattgacgttttttggtggctacgtgctttctatcaaagacgagccgtacagatacattgttcatacttttactttaagtatgattgataaatgtagataaggagaaattgggaagatttacgtctggtatcacaccgggtatcacattggtatcacaccggtatcacccctagtatcgcattggtatcacaaatatgtcactatttactataccttgtcatagtttgacgtaattagtactatcttttgatactcctttagatgtcaattcatacaacatctattcaattaatctgctgtaaaccaacaaaataaggaggcaaaaacctcctttttcctagtacaccctcagggactcgaaccctggacccattgattaagagtcaattgctctaccagctgagctaagagtgcaacattttatttttattgcaacgtcgaatttgtacaccctcagggattcgaaccctggacccactgattaagagtcagttgctctaccaactgagctaagagtgcttaattcctcgtttgcggttgcaaaagtaggtcttttattttatttgaccaaacaatcatgcagcttttttactatcttttttcgtctttattcgaacacataaagctcggaaggcgtatttcgctttaaagcaagtagttgcacatctttgcctacaataacacctttgttctttaatttccattccaccgttttataagccagctccgggtgattattgtctttacttaaatggcataaccagatatatcgcaaatgttcagtaatattttccgccagaaactctgcagtatcagagttactcatgtgtccggttttacttgcaatccgttctttcagatattgaggataaggccccattttgagcatttcctcatcgtagttggcttcaagtatcagataatgggctttactgatataatgagcagctgtaggagtaatctctccaaggtcggttaagaaagaaaagactttgccatcaatttcaatgcaataccccacattgtccgttccatcgtgtggcacttcaaaagattcgatgtgaaaatcttccagcgtcataggctcttgcttttccagataacgaactgacgagctaagtttctccgtcatacaatagctacgattaattccagcatgaatacgtgcggttgtataaacaggaatattcattttttctcccagattacccactgctttaatatggtcagcatgatcgtgcgttataaataccgcacgaatactatccatcaagatattataatctttcagtgattttttgatagtacgtatgccgattccggcatctatcagtatcccataggtttcagtgcccagataataacagttcccgctactgccactcgccaggcttataaattttactttcatgttttatcctctttattaaaatgcaaaatgccgtcaacttttacagcaaagtgacggcaaatatacataaaaaagcagagaattaccgagaagcctccttctttttgtcgatggattcggtgatttttgcaaataatagtagcgctacagcggcaatcaggcctatagcagcaaagtaataccatatataatgggcatttccactagctgcctcccatgcttcccgcgtctcgaacaaagccggatccggacaatatttagtgagcaaaattcccgccagaccaaaaccgaaaatagaagaaaggaatgaatgtaaatgactgaatcctaaatacattccttcttctcctttcggagcctgtaaagagaaatattccagataacgcggtgaaatgaaacattcggcaagcgcctgcacaactatacccgcaatcatcatcagagtaatattgctcatacctgtaataagatcattacccaacaaatttccacatgccatcagtaatgccgaaataggaatcaaaaacattcccacattcatcgaagtaatcgcactgcgtttggccatcaaacgggtgataaaactaacgcagcaaaccaccacaaacggattcacgttggcaatccaacccggttttgccgtctctccagccatacgaatcacatatttaggcatagtggcataaagctgctgttgcaccatccagaaacctgtaacaatcaaaataagaatcaataaacgccagtttgtgatgattcgcataaatccctgtccaatctcatggagactttttccttcacctgccgtatgcgtcgatttataaagaagaataacagcaagtaaagcaactattgtcatcgcaccggagaaataattaatatagatatacgcttgttcaccaatgacattacgcaaaggatcgataatcgttttaccggtgaaagcacccacatttaccatcatataaaatatggaataaccacgggcacgggttgcttccgttgtttctttagccacagaagcggagataatggacttaatgaaagaacctcccaccataagtacaaacaaaaccggcacgatgatccaccgggtatagctatcaggcaaaccattaaattgagtagtggcaccataactaaccaaaccggcagcttccagtaaagtgggcagtacacccaaccctaaatatccgatggataataaggaaaatgctataatcattgatttccggaaaccgatcttgtcagcataagcaccggaaaaaataggaagcagatacaatccaccggaaaaaagcccggaaatcatacttgcttcgaaatcattaaaacctaaaatggaagatagataaatagtgagaacgataaaaacggcataatatgccatacgctcaaacagttcgactgtgttgctgacccaaaatgctctcgtaaagcctttagcagcacgctgaggggaattgttcatgtatttatatttttattaaaatgttaatttgagacaaagatacgtttttttggcttactgtccgtatctttgttccaaattaggtaattaaaaactatgattatagctgttgattttgacggaacgattgtagaacatcgttatccacgcattggtgaagagattccattcgctgttgacacattgaagttattgcaacaagaaaagcatcgtttaatactgtggagtgtgcgtgaaggagcacttctggacgaagctgtcgaatggtgtaaagccagaggtttagaattttatgccgttaataaggattatcctgaagagcagaaaggccatcagggattctctcgaaagttgaaagccgacatgttcattgacgatcgaaatctgggtggtttaccagactggggagtcatttacgaaatgattaaagagaaaaagacgtttgcagatatctatagccaaaacggagaagaagaaaaaacatccctgaaaaagaagaaaagatggctgcctttttaggaagctgataaatatcaaactaataaaatagaaatgcactcttatctgacatgattagagtgcatttctatattcataaatgatttatcattcaacattgaatcgcaatttgctacgcttctttattttcccacttttccctaaactcccataattgctcaatagtgggatgaaaagtcggattctcccagtttctggaaatcattgcaatcaaagattccaaatacgatttaccatcaataatggtagtacatttattgacctgatatctttctgttggataattctttgtctcaatcatcttttttgcccagttcaataattcctgaacagcttcattgtcataagtatgttgtgccatatctttagaattttccgcaaagatacaaagtttatttattcataaataaagttgttcgtttctttttactataaagattccattttaaatttatacctttacgtccaatatactcaattagactaactaatagaaacaataattatgaagaaaattttcattttagtatgttcatgtgctcttttggcagcatgcaacaatagcgcgaaaacaaacaagagtgccggtgcagacagtacttcaatcgaagtaaccgatatccataatgcggaaaattcacttgattacgaaggaacttataaaggagttttccccgctgccgattgtccgggtattgaaacaaccctgacattaaatccggacaaaacattcagcctccattccgtatatatcgatagagacagctcatttgacgaaaaaggtacatatactttaaaagacaacctattgactcttaatgaagaaggcggagaactttcttattataaagtagaagaaaatcatttacgcaaactaacaatggataaacaagaaataaccggagaacttgcagaccattatgttttaaataaggaataaggtccaaacaaattttgctatcaatagagaacaaattcaatattttttatgtttatataaatagatataaacttaaaaatagaacaacttatgatttatagttttttatttcccacaaaatcgaatacaacgaaagtatctttgttgctattggctgtccggatcatcttcggtatattattaatgaaccacggtatccagaaatggagtaacttccaggagatgtcagcagtatttcctgatccgcttggaataggaagtcccctatctctcggattagcaatttttggcgaactcgtatgttcgatggcatttatcatcggattcctgtatcgcttggcaatgatcccgatgattttcacaatgatagtagccttctttgttgttcatgctaatgacgtatttgcggttaaagagctagctttcatctatttagttgtatttatattgatgtatattgccggtcccggtaaattttcaatagaccatatcataggaaacgaattgtcacggcggaagtcaagagtatacaaaaattagaaataacagccccgattaattaaaaaatattatatttgcatacacataagagagaaattatcaatattttttattaatcaaaaacattttaacatgaaaagaggaaaactgactttagtcgcagtagtacttagtggtagcttattattcagttcttgtgtaggatcatttggtttattcaaccgcctgtcttcctggaatcaatcagttggaaacaagtttgtaaacgaactcgtattccttgctttcaacattgttccggtttatggtgtagcttacctggctgatgctttagttatcaactcaatcgaattctggagtggctccaatccgatggctaatgtaggtgacgtaaagaaagtaaaaggagaaaacggcaactacatggtgaaaactcttgagaatggatattccattactaaagagggcgaaactgcttcaatggacctgatctacaacaaagaagccaacacatggaatgtcgttgcaaacggtgaaagcgctgaattagtaaaaatgaacaatgatggcactgctgatttgttcttgccaaatggcgaaaagatgaatgtaacgctggatgctcaaggcatgctggcagcacgccaggctacaatgagcaattttatgtttgccgcccgctaaaaataaaaacaaatacgaaggagatgaaacatcatataggagtttcatctcctttttcaatcttatcttcttctatcaagaatcttttgtactatgaataaactacatacacttatctattctgttctaatcttcacctgtctatcttgtcagcaacagactcctcaaactcaaatagaacagacagccatagatttttgtgaagccttttataatttcaattatccggtcgccaaagaatggagcacgccttcttctcaatcttatcttagtttcttagcatctaatgtcgggcaaccccatctggagcaacttaagacacgaggcgctgcaaaagtttctgttatttcaagtgagatagatgctaatttagaagaagcgtcggttgtctgccaaatcaaaaatgcattcgtcattcatcccatcggaggaaaaatggaatacgtaagttccctgcaagatacgctcgaattagtaagagtaaataataaatggctgattagaaaggatatcccacagcaaaatggaaagcaaagtcacgactgaatttaggatgaatgatggggaaatgctctttcctcgtttcataggcaggattgacagctttcatacctccgtcaaaacgcaaaataaagaaatccaaatccaggcggagacctaatccgtaggccactgctatttgcttataaaacctatcaaacttgaaaacccctcccggttgattggcataactccggatggtccagatattaccagcatcaataaataccgccccctgaaacttccagaataacttgcttcggtattcaatactggcatccagtttaatatctccggattgatcgagcaaattcccatttcctgcaaaagagcccggtcccaaatcgcgaacactccatccgcggacactattggctccaccagagaaatattgtttctcaaacggaatagtcttcgcatttccataaggtacagctattcccacaccagcatgaaacgcaaaagagttacgataatcgattctgatattcttagcaaaatcaaactcccctttcagatattgagcataaggaattcccagaatagcgtattcaccattactgttcttccgaatgtttgcagcctttgacagagcatacattacatttcccgccgattcgaaattaaaacggatggagtatgaattagaagcaatcgtattattgataatcgatcctcccacgctattataattatagctatatcccatatttataatcagtcgatcctgataattatactggaatatatggttctgtcctttatttatatagtcttctttaaacctttcagagatacggggcaaataaaggaaagcaatatttatcaaatcaatacggtgttgtatcttctgacgttgtgtccacttgtaactccagttagcagaagccatcgtacgcaagaactccggtcgcaactgataattatactgtaaaccaaactctgttgtagccctgattttccgtttaaaatcagaggaaatgaatgggaacaggaaattaggaaagttgatactcgtttccactccatactccgtatagttattatttgaatagcctgcctgaagcccggaaataacctcatacgctccacggaattttatcataaacgtttccgacccgcgaaagagattcctattctggaaagaaacggaagctgccgctcccaagtcaccggcagaattggttccctctacctcaaaggataccgatttatgcttgctcttagtcaacatcacgtaacaatcgagcattgttgaatctccaacttgagtctcgataaaacggatattcgtatatttcaatgcagacaaacgcccgaaactggaataagtttgctgcacatcacgctcattaaacaaatcgccggaagcaaaccggaggttatccgtaagcactttaggacgtaaatagagcttatccttatagtaaatcggatatcccttataatgaaccgaatcattaatatccacactgctcaaggcagaagactgcaaaacgtcataatccgtaataaaattaatcttattgatccaatattgctgatgtgcccttgccgaatcactcgcatgcgctttatacatctgcaaatgttgagtcagatctacattataagtattacgaaccgtatcggccgtatatccgatataatccttattaaatttataatagccattccgaagcaacttattcgtgatacgttgtctgtccgcatccaatacattcacatccaaatacattccttccttcaacaagcttctggcagaatcctgtttgagaagagaggctattttaggatcataaatatcatatttgatagattgaacaacgtagggtttgccggtcgttacatcataatacagcttaatctttttcttttttattttagtcgaacgcttcacggttgccgccatatatcccatattgtgcacagccttagtgatctcttcttcagagcgtttcgcttcgtcctcgctatatattacaggagcatcccctatccttcttaaaaatttgtttccccatttggtcgaatcacgccccgacagattatatacataaagttgggtctttatcagactgaaccacttggcattaggattttggcgaacatacatgcgcaaggaagaaggccgtatatttttttggtccgtacgaattttgacttcatccagcaaataagatccatccggcacaaacttagtggtagtacacgaagcaagtgacaagacagcagcagaagcaagcaaataaagaaaatttctcctcatacggttttacatcgatagtatgaaaaatgcgcttacaaagataaattatattttccgacggggaaaataatttaagaaaaagagaggaaagtaaggatagattggaaatatctttatagctttgcaaaagaatatcaaatctatggcatcattaagtaaaaacaaaataaagtatatccactcgctggaactgaagaaaatacgtaaagaagagcgggtatttctggctgaaggtcctaaattggtaggtgatttactcggacattttccctgtcgttttttagcagccactccctcctggtttcaggagcatccgggtattgacgcaaatgaactggtagaagtttcacaggaagatctttcacgggccagtttattgaaaactccccaacaagtacttgctattttcgaacaaccacaatatactttggatccggaggcagttcgttcatcactttgccttgcattggacgatgtgcaggatcccggaaatctaggtaccattatccgtttggccgactggtttggcatcgaacatattatctgctcgcagaatacggtagatgtatataaccctaagaccatacaagccactatgggtggaattgcacgggtgaaagtacattatacttccctccccgattttatccggtcgctcggagatactcctgtgttcggtacgttcctggatggaaaaaacatgtatgaacaaccattgtctgccaatggattgatcgtaatgggaaatgaagggaatggcatagggaaagaggtagccacattaatcaatagaaaattatatatccccaattatccggcaggccaagagacatccgagtctctgaatgtagccattgctaccgcagtaatctgtgccgagttccgtcgacaggctgcatggaagtaaaatcaaaaggataaaataaataaggaaataaagcttcccccttcttttctgcttcctgcagatactcattaaaacattgggaagattgatgcgaaacactggcactgggaagattaatttgaaacactgggatgttttttaaaatcatcccagtgttttttatttcttccatctgactttcagaaagcagcacaatcactcccggcatccattcaaccgattcaatctcttcggtcaatgggaacacacctcggacaactccttcgtcagtgatctccactacctgctgcttcatatatccgacggcaggtatcagcaaataatgagaagcaaagcgtttcattacaatcagttgtttgaacgtctttgttgttgctgcctgcgttgattcatctggcgttcttttctttgctctatccgttccttttggatatgctgttccacctgaatctgctccggcttcttctcacgatgagttcccgtacgacgacggttcatctcttccggtgtcagacgctgaatgtcatctttattcttgtctatgaccttatgtaaagagtcggcattttctttagtagctatcttcttcaaagaatccgctttcaatgcttctatcttattcaaagaatcgcgtacggcaaatgcgagcgtatccgtacaatgataacgagtcatcatgaagcggtcggccaatactgccccgcctttttcctggctatccatcggataataaatgaacccttttatttctttcatcgaacctaatgtgtctgcaaacaaacgaatttgttgcacacccggttcagtcaccgttttccaatgattgatcgtatctttctcataaatcacctgcatagccatagtgacacctcttaaagagtcggcaagcatcggctccaggaaacgataccgcacttcccataccagtgtatcccggtctttgtagttagagtcggtcggcaaagtaaatacatattgattatccatcatttcaccggtcaaacgtaccatacgctgccacggccagacatcgatgctatcaccctgcttagtcattttcggtttcttatcacgcttggctatcaggtcgccaacaagttcctgttcgtctttcaagcgttttttcaccttatcataaattttcgataaaatctctgtgttacgggtataccaaaccatggatgagtcaaatgcagcttgtgtagtcccgtatttcttgaaaacggcgttgatatacaatgctttcttatagttctcactataaggcaaattatctcccatagactttgccacatgataatcatacagcaaattctccatcttcgattccgagattacatcactgggtcttttcactttacacccggctaccgcaaaaacgaacatgcagatgagacacagatgaaaccgaaatctatttttcatgatccgtagcttcctttttatctttatccagcgaatgataagactcattcaaatatttactataaaagagtaacaaggcaatgataccgcaactgatagcggcatccgcaaaattaaagatcggactaaagaatataaaatgctctccacccacaaacggcatccatgtaggccagtttgtatctataatcggaaagtaaaacatatccaccacttttccgtaaaaccaggtagaatatccaccaccttcgggcatgaaactggcaatctgcgaatgagtgctttcattgaaaataactccatagaacacgctatctatgatattccccaaagcaccggtcagaataagagccacacagacgatataacctgttttgaaccctttctttatgattttatagagataccaccctatcaatgctaccgcaacaatgcggaatgttgtcaggaataacttgccgaagatttccataccgaaagccatcccgttgttttcggtgaaatagatataaaaccaatcggtcacacgtatactttcgtgccagtacatgtgagttttaatccagaccttgatgatctggtcaataatcaatacggaaaagataacgagaagggcaattctccccttcgtgaatagtttcttcatgtgtttattataagttaaacataacgagctacaagtgccgtgcgtaaactttgcgcagctacttgtagctcgttacctgtagcctacttgctatctgttattttttaccactgttctttgcttcaatgcttaatgtagcatgaggaacagcacgcagacgttctgccggaatcaactttccggtttcacggcaaatgccgtacgttttattctcaatacgtaccaaagcagcttgtaatccttggataaacttcagctgacgttgtgccagtcgggtcgtttcttccttggagagcgtattagctccttcttccaatactttatacgtaggagatgtatcgtcggtatcattaccgtccagtcccatcaaacttttcttcaactgttcatagtcacgttgtgccaattccagtttctccataataatggcacggaattcctcgagttccgcatccgaatatctagtcttttctgccataactttacaattttaaaaggttaatcaatatagtattagtcttttatcacgttcacaaacaatgagaagtcgtcaaactccagcattgttccgtctttcacttcatctacaagttcaagagatgtgcctaaaacctggttacaaatataagtattatattcatttaccgcatcatctgtttgcgtatttttcgagatagttatttttattttgtctgtaatctcgaaaccgcttgacttacgtatattctgaatacggttcaccagttcacgggcaataccctcgcgacgcagttcttcggtaatggtcacttcaagcgctactgtcagtttgccttcattggcaaccagccatcccggaatatcttcactaaagatctcgacatctgatgcttcaataacagcctccgcaccatccaggtttaatgtatactttccgtttttctccaattcaccgatggcttcctgtgacatttctgcaacagcagcagctactgctttcatttgcttgccaaatttcgggcctagctttttaaagtcacatttcacttttttcaccaatacaccggctgcaccatcaacgaatctgacttcttttacgttcacttcattcataatcaggttcttcacagcttcgatatgagctttctgctcttcatctaccaccggaaccatgatacattgcagcggttggcgtaccttgatattcaccttgcggcgcaatgccaacaccatagatgtaacatcctgtgccatttgcatgcgggcttccagttccttgtctatcatttcttcctgatatttcgggaattcggcaagatggacagaaactacattgtcgcgtcctgttgctgtaatcaagtcagtatacaggcggtctgcatagaacggagatacaggagccatcagtttggcaactgtttcgagacaagtgtacaatgtctgataagcagacaatttatcctgtgtaaattcaccaccccagaaacgtttacgattcaggcgaacataccagttggacaaattatcattcacaaaatcagaaatcaaacgtcctgcctttgtcggttcatattcattatagcatgtatctacctcctttattaatgtattcaatacagacaagatccaacggtcgatctccggacgttctgccatcggtacatccgcttctttatactcaaatccgtctacattcgcataaagcgcaaagaatgaatacgtattatataaggtaccgaagaatttacggcgaacctcttccactccttcaacgtcaaatttcaggttatcccacggagaagaattggtaatcatgtaccaacgcaacgggtcggaaccatacttttcaattgtagtaaacggatcgacagcgttattcaaacgtttagacatcttgttaccgttcttatcgagcaccagaccgttagaaataacagctttataggacacactgtcaaataccatcgtagcgatagcatgcaaggtaaagaaccaaccacgtgtctggtctactccttccgcgataaagtcagccggatatacctgacggttatccaacagttctttattttcgaacggataatggatctgcgcgtatggcatagcacccgaatcgaaccatacatcaatcaagtctgattcacgcttcatcggtttgccgtctttcgataccaatatgacgtcgtctacataaggacggtgaagatcaatcttatcataattttcttccgaatattgacccggcacgaaacctttatccttgtatggattggatttcataaatccggcagctaccgatttctcgatttcattataaagttcttctacagattcgatgcatatctcatccgtattatcttctgtacgccagataggtaatggagtcccccaataacgagaacggctaaggttccagtcattcagattttccagccacttgccgaaacggccggttccggtagattccggtttccagttgatggttttattcaattccatcattcgctccttgcaagcggtagaacggataaaccagctatccaacggataataaagcaccggtttgtctgtacgccagcagtgcggatagttgtggacatgcttttctatcttgaaagccttgttgtctgctttcatcatcatggcaatgacaatatccaacgattcggcagcctgcgcagctttctcatcgtatttgccatccaccataaattgaggatcataagcatttttcacccatgcaccctgatattctttatatttatctacatcaacacattcttttacgaaattctcatccagttcatccaacagatagaatttaccagtcagatccaccatcggacgagtttcgcctttcttattaatcatgaaaagtgacgggattcctgcagcacgtgccacattcgcatcgtctgcaccaaatgtaggtgcaatgtgaacaatacctgtaccatcttctgtagtaacataatcacccggtattacacggaaagccttatcactaggcttccagttgccatcttcggatacctcaaccggtttcacccaaggaatcaactgctcatattccataccgacaagatcagtacctttatattcggcaatcactttaaatggtacaagtttatctccagctttgtagtcctccaatttcagatcagcagcttttgcattgaagtgtacattcaataaagcttttgccagaacaaccgtgataggttctccggtataagcgttgtaagactgtacagccacatagtcaattttgggtcccacacaaagagccgtatttgaaggcaatgtccatggagtagttgtccaggcgataaaataaggagttccccattccgtcatttccggtttaggattcttcattttaaattgggcaacggctgttgtatcttttacgtcccgataacagcccggttgattcaactcatgtgagctcaatcctgttcctgcagccggtgaatacggttggatcgtatatcctttatacaacaatccttttttatgcagttgcttcaatagccaccataatgtttcaatatagcgattatcatacgtgatataagggtgcttcatatccacccaatatcccatccgatgagtcaggtcttcccactccttggtatatttcatcacgtctttccgacaagccgcattgtagtcggcaacagagattttcttaccaatatcttcttttgtgatacctaatgccttttctacacttagttccacaggcagtccgtgcgtatcccatccggctttacgcttcacctgataacccttcatcgttttgtagcgacagaaaatgtccttaatggtacgagccattacatggtgaatacccggcataccattagccgagggaggtccttcgaaaaacacgaacgaaggacagccatcacgttctgtcatactcttggcgaaaacctggttctcgtcccatttcttcagcacatctttgttcacctgcgaaaggtcaaactgcgaatattcagtaaatctcttacccatagctgtctacgattttactatttacaatttacaatttgaggggtatccccatttttaagggtgcaaatttacaaaaacatttgtttagttgagcaaaaagctaggacttttaatcggattcgtgtgaagttaacaattataaaccgcctacagcctaaacaaaacaggtatctccttgttttagtgggaaacctaaaagcactttaacttatgaattacggtattagcattttattcagagcaatccctttggcgatggctattttttgcttcggatacggagcgtttatttatggttatggagatgacgggagtcgtgttgtggccggtcctgttgtgttttcactcggtatgatatgcattgcactgttttgcacggctgccactatcatccggcaaatcatacatacttataataaatcggccaaatatgttttgccgattataggctatctggcagccatcattactattattggaggtatctgcattttcagtaatgccacttccacctctgcatttgttgcaggacacgttatcaccggcgttggatttattaccacttgtgtagctaccgccgccacctcttctacccgattctctttaattccgagaaattcaaaagcgacaagtaatgaagttccggaaggagctttttcccttaatcagagacgggcattggtcattgttgccatcatcgtttcgctgatcgcatggatatgggcatttgtattattaggcaacagtcattctcatcctgcttattttgtggcggggcatgtaatggtcggtctggcatgtatttgtaccagtttgattgcgttggtagctaccatagcacgccagatacgtaatgattattcagaaaaagaacggaataaatggccgaaactggttttattaatgggatctatctcttttgtatggggattattcgtgattttggcagattccggaagtgcaaacggtaccaccggatatattatgctcggattggggttggtatgttacagtatttccagcaaagtaatcctgctggctaagatatggaggcaagaattcaaattagccaaccgtattcctatgattccggtattaacggcattaacttgtctgtttctggcggcttttgtattcgagcttgccactatacatgctgattatttcattccggcacgtgttttggtaggtctcggagctatttgctttacgctgttttctatcgttagtatattggagagtggcacgtcttccaaataaaaaagtattctatcaaaagggcgtcactatatgccccggatagtgacgctatccaaggcatatagtgacgctatccggacagcatagcgtcactctttttatttcttgtatctcacctcatacaggtcattcctgcggtctttcaagttgcgtacactaccataagtatgcaactcgttcagcaaatccagatcaacatccgataccaaaatcatttcggtgttaggagttgcctccgccctctttccgtctgttggaaaagcaaagtcgcatggggtaaacacacccgattgggcatattgaatatccatattgtgcacacggggaagatttccgacacttccggcaatgactacaaaacattcattctcgatggcgcgtgcctgcgcacagacacgaacacgggagtaggcattctgggtatctgtcaggaaaggaacaaataatatctgcattccctgatctgccatcaggcgggaaagttcggggaactcgacatcatagcagatcaaaactccaatctttgcacagtccgtgtcaaaagtattcagaagtttaccaccattaagtccccagctttttatttcatcgggagtgacgtgtaatttttcatacatttcgtaggttccatcccgtcggcaaaggaaacctacattataaagcaatccgtcctcttttacgtatggcatactcccggttataatgttaatattatagctaatagccagattcataaaccgttcccgaatttcatccgtatactttgccaatccgcgaatagcctgcgattctcccttatcgttatacttcgacatcaaaggagcattgaaatattccgggaaaagaacaaaatcacttttataatcggagactgcgtccacaaagaattctacttgttcgaacaggtcatccaacgttttataactacgcatctgccattgcaccagtcctacgcgaaccgtagttttgggactgatatattcttgtgtaggtggctgataatagatattatcccattgcagcaaacaagcataatgttttgattcttcatcatttggcagataattagtcattaccttacgaacgtgaaaatcattcgacaactggaaagtaagtaccggatcataaatctcgcgttgacgtacccgttcgatatattctttcggacgcattttgtcagcatatttatgataattcgggatacgtccgccaaacataatcgctttcagattcaatgtttcgcaaagctccttacgatattcatacatacgacgtgcgagacgcaaaccacgatagcccgggtggataaatacttcaatgccatacaggatatttcctttgggattatgtgtattgaatgtttccttacccgtaacctgtgcatacgtatggtcgttctttactttatcataatcaacaataatagaaagagcacaaccaactattttatcgtcaacgactgtgacgatctgaccttccggaaagattttaatcaacttctgaatctgctcacgagtccaaaacacatcgctaccgtcagaataaacacgggtaaacgattgggatagttgtacataatcttctatttgcagattacgtatctgcactttattaatttttatcggatgttgttccataacaatacgtgtttttatataaagactgtgcaaaggtactgtttatctttatacattgtcattgcaaaattaaaaatgcattatacttaattttaatacatgcttcagaaatggctacagtgctttaacatcacataattttcatacaaattcttgcgccgtttaatttgcgacttccgaaaattatcgtacatttgcaacgcataacattttatacccacagaagcagtgaacctgcttcaactccagtagcaggcatttttatgcctgttgctgccgtagatacgcggtttcgtacccccgtggggaacgttaatgcgtccccagcttctgtggagtgttatgcaacgggaaaggcggaaccgtttttttattcccgcctatcttaaaaccgttgtatcatgcatgaagaacaaaacaatgcacctgtaaaaaccgttcaaagcaatcggcaggaagctaattttcctaatctggaagaaaaagaaaacctaaaacagttttatttaacccaatcacgacgactatgccctactgtatcagtcgatcgttcggaattacaacgtttgggagcgttacaccacaaaatcaaacattttattaaagcgttaaccaacctcgaccgttcatgggaaaatgggatgccggagatgcaaaaggcttgcctgcatttcttttctttacaaaactcacctcgcacagagtgtcaaaagatttttgaagaatgggcgaaatggtcgaacttcctgatatcagcttcttgctatcgtggttttgtcagtcagatgttgcaggattatcaacgtcaattacgtgacttggaaaagctcttgggcggcaaaccttccgaaactttggagaatgtatctgaccgttaagtcatacagatagatattgcatcgaactgacgctaaaagtagttcgtttcttgacggttttaattcttttcagaatataaatgagttaaatgataattttgcggagtgccctgaaagggcttaattatatagcgtagggcaacgccctacgtaaaaacggcaatctgaatttgcgccctgaaagggcataattgtatacagttccgccctttcagggcttgtggctggtgtgtttttttcgtagggcgttgccctacgctatataattaagccctttcagggcaccccaataaatatataattgtaaggctttcagcctaaccgataaattctcatttaaccgataaattctcatttaaccgataaattctcatttaaccgctaaattcccatttaattaagaactgtactgaaatgaatgaaagtttttcctactataaagttgaaaaacataaaaacatctgccacctgcaacgaaacaaagcaaagcttttctcttgattttttagaaagaggaacatttactgaatatccctaagtacctgccactaattaattgctattttttaggcacggattacacggattaacgcggttgtttttcagcaatgataaccctaaagaccgtgacatacgtgtaatccgtgcctaattattatttaataaggaacatttcttccttgctgcacctcaattcgtattccgaaattaccattggcagatttcagttcgaacgctccccggaaattatttctttcccaaggcatagcactgcggttaggcacccgccagccatccttgttgtaatctccgtaagtattgattctcattccgtttttcagcttgaaagatcccatctgcataaactgtggagaagaagacaatccccaaccatatccgtatccaaaaccggaaaacccggagtaagaagacgaagaaaaagagtcggtgaatccttgagaataggtaatatccgtgtttaaacgaaagagctgattataatctttcgtcatattaggcatatctaaattaaacttgggaagttcgggagttgctacgttcattaaccccatatccagcagaaaaccaccaaactctttgatattggtagatggagcacgacgaatactatcggaaggaatttccgactgtgcggatgcaaaaccgaccgataatatcagcgaaagaaatagaatcagttttttcatcttcgtaaaggttgatttaccacaaagatagataatttccacctgactatccgcttccgttatgttttcttagaaaaaaacttatcttttcaatttaatcaccggataaacgacaggagccgtctcccatttccttttcatcgggttgtatgagcgttccatgcctccatggagttcgatataatcgttgaacttgatttcaagcatcatgccataaccgctttgcggatagataggagtgagatacccctgcgaagcatttcgttcgccattcacagaatattcgccgaaagcccgtatacgcagaaaattattaatccggtaagcggccgaaccgctaaaaccaaaatcatttctggcaccatgttggaaagaaggcattgtatacttagcactgaacagcccacctgaaagctcccatcgttcattaggggtatacgtataaatggcacctacctgaatatgcgtccccatggtaggatacgtattatgcaaactatacgtacttaaatagctgttagcattgatcccgaaaatatccgaccgattatagtcacggctgaaaggatcgaaagaagtacccagtctgggagtaggccagggaatatctataaattcgggaggagatatatgaagtgtcatgctatccgtttgaaaggttggcttcctgtcgttcggcgttacactcatatcgggtaagatgaagccctccttatccatatttaatggctgcttttgctccggtggcagaagaaccgcacggccgatgctatccttttttacttccacctgttgcgcaaatgcggtacaggtacaaagtaaaaacataaatcctgtgaactgtcttttattcatggcactttgcggtgttaaagagtttagttgacaatcagtttataaccgattccccgtacattgacaatacgtatctgttcatcttgcgagagcttatgccgcaatttggtaatgaacacatgcaagcttcgggaattgaaaaaactgtcgtctccccaaagttcgagcaagacatcctgcgtgttgaccacctgattccggttttcgcaaagccgtttcaagatttccgattcacgatgagagagttcctgtctcgttcctgcgtgtaataaagtttgtgcaacaggatcaaacagataacttcctatctcaaaatgattggcaaccttattctctgtgaagagaaaagcctttcccatcagtgctttgattcggataatcagctcttgtataccgaaaggttttttcaggtaatcattcgctccgagttcaaacccctccaccacatcattgatggccgaacgggcagtcaggaataagacaggagtctgtttatccgtctggcggatgcgacgtaccatttcaaagccatccattttcggcatcatcacatcggctacaagtacatccggatgaagttcgaagaaaaggcttagtccttcctcaccgtcattcgccgtatgaatgataaaatcattttcttcaagtgtatccttgataatcatggcgagcgtctgttcgtcttctaccagtaatacggtaattttgtttttactcatgattttatgggtttataaagtaatggtaaaagtgcttcctttgtccggttcactttttacggtgatagttcctccatgtttttcgaccatactcttgacatagaacagtcctagtccgtaaccttttatattatgaagattacccgtcgggacccgatagaatttatcaaatatgtgcttttgtttatcaagtggaatcccgattccccggtcggtaacgctgacggttactgtcccctcagtctgtcggcaagaaatagacaattcggcttcctccttcgagtacttcacggcattatctatcaggttactgatgatgttgctgaaatgcgtacggtcggctacaatgacaagcgtttccggtttaatatccaattcgatatgtacaggcttgtccgcttttagctggtgctgctccatgagcggagtaatcagctccttcaggttgatttcctccggatgcaaacgaaacgttttgcgacgctccattcccatggataaaatctgttccaccagtccgctaagcctttgcaactgctcctgactgatgcgtagatactggtcgcacttgcttttctcttccgcctggttaaagttcagtaatgcgtcattagccgcataggctacggcaatgggagtctttaattcgtgcgtgatattattggtaaaatcacttttcatttcatccagcgttttctgtttcagaagcgtccggataaggaaccagaaagagaatccgagaatcagaagaattacaaatgaagtgaccagaatacctgtcatctgctttaacaccaatgaatggatcggctcgaacaccagttggtagcgttggctgtgatgcatattaaattcatagtcatagcggattgccttaggactgggaatataactgctatctcccgcaatacctaatgtatcggtatatacaatggaagaatcggcactgatcccggtataaatcaaaagagtgtgatgaggaatagagagattatgctctttcatcacatgggtgagcaaactgtcatatcgttgcaggttgacatctatataagtatccacacccgaatgaataccctgctgaatactcattaacagctcctttagcgaatcttgctttttcaataacacatccagcccgttctcactacttgcaacaggtgtagaatcttccggagcgttaccaacggtctttaccgtatccgtggttgtttctgtccgggagtgtatcgtatcctgacggctactatccgtataagaaatcgtttgtttagtcactaatgaattgccgtccgcatcatatccggccgataccgtcagcgaaccgtgttccacattatctttttgcaaatcatttacccggagcacgacctcgttaaagtcactcgtccgcatcgcatctctgatattgctctccatttccatcttcatcgaccggtaaagccctgtcaaccaataagcttgataaacaaagattccgattaatgagcagataaccagtatgacaatatgttttagtggtaatttcatactgacaaagataataggaaactattcttattcttctctttgataagactaaataacactagataagccagtgataacgcaaatttccattttttctaccgtattttgtcgtattccaaaaataaagacgaaatgaaacggattaatttactatttatgtctcttctatgtgtgtggatatccgctacagcgcaagtcggacaacagtcacaggaacctgtcgacagtatcaagaatataggttatatggatagtttatttcaggaactgcccgaagtgatgattacaggtgaacgcccgatcgtgaaagccgaacaagccaaactcgtgtatgacgtgccgagactggtgggcaacctgcctgtggataacgcctatgatgttgtgaaaaatcttccgggtatagtaaatatgaataatagtctgatgttgggaggacaggaagttaccgttgtcatcaacggaaaagttaccacactgtctgccgagcaattagatgctttattaaaatcaatccccgtcagccggatcgagaaggcggaagtgatgtattccgctccggcacgctatcaggtacgcggtccgatgattaacctgatattagcacccggcacaggacaggcatcttcccttcaaggagaactctatacagcttttaaccaacatcactacgaatctttggcagaacgtggaagtcttctgtactccggacgtaaattctctgcagatcttctttactcttactcttatgatcgtgaccgaaggattacggagaaagaagcacttcacacgttagccgatggttcggtacatcagatggatatggatgaaataatgacttcccgtaccaacagtcatcaggtacgtctcggaatggattactctctagcagaagatcatctgttaagcctggtctacacaacagcttttaccgactccaaacattattccatagctaccggtgcgcaaaactctgttaccgattcacagggagacagccagctccataatgcaaagttagattatcaaacccctttcgggctgaaagctggagtggcatttacatcctatcattctcccggcagccaattattatatagcacgatgggaacagagacaatgaatttcttgagccgggataaacagcaaatcaatcaatggcgtttttatgccgggcaagaacataccttgggcaaaggctggggattgaattatggcataatctatacggccgctttagaccatagctaccaaagatattatgacccggaaacagataacctgttaccggataataacatgaactccagccgtcgcgaacaaaccctgaatgtgtatgccggactaagcaaaagcttcggtgaaaaactctcggccgatgtttctctggcagcagagcaatatcatacaaatatctggaatgaatggagcctgtacccggtagccaatctaacttatatgcccgctgccggacatgtcctgcaactctcattaagtagtgacaaggaatatcccgaatactggagcgtacagaatgcaatctcttacatgggagcatactctgaaattcaaggaaatccctatctcaaacctgccacgaactatgaaaccagccttaattatatactaaaaggcaagtatgttttttccgccttttatagctataccaaaaacaagcagatgcaaaccctctaccaatcaccggaacgcttggtagagatttacaaattcttcaactttgatttttcatcacaagccggattggtaatgacagttccctttaaggtgaaaaaatggctcgactcccgtatcacagccatcggttttcgttatcgccagaaagatagtgacttctgggatatcccatttgaccgtaaactatatacattcgtcttgacgatggacaacacatttaccctttccaccaaacccgacttaaaattcactttgaccggattctatcaaaatagagctatacagggaattttcgatcttccccgttcgggaaatctggatgcagcgcttcgttacacctttgcaaaaggaaaagcacaattgacgctgaagtgtgacgacctgttcaatacctccaccatttcgacacaagtccgttacggattgcagaatgtgaaaaaccactatctgcgcactacccgtacattcggtatttcgtttaactataaattcggaggatacaaagagaagaagagggaagaagtcgatacctcccgctttaaataagcgggaaataactcatggttctattcattcatcggtaaattgacaaccacccttgtgccatccgtatattccgggtcaattttaatctctccgtcaagtcgtttcacgatgagacggcagagatacaatcccaacccattgcccggaacgaaagtatcaagtttggaaaaacggttgaatacctcttcctgtttttcttttgggataccgcaaccgctatcggtgacactgatacatatttggttcttcgaaagattgaccttataccctaacgcaataaacccttcttctgtaaacttattggcattattcagtaaatgctcaatcaccatagtgagatattgggcatttgtcggaataaacagtgtattttctgtaatatccaattgatattttattctcggtttgggggaaatcttttccatttcctgcatacacatatttctgatatcaacaggttcacaaggcagcttatcttccgaaacgtccagattcgccacttccagcatactgttgacaagcccggtgagcaactgggtacttttttgtatttcggcgggaaattcccggcgtgtctcttcgtcaatatcttcattcattattaagtcggagaaccccacaatcgcattaagtggcgtacgtatctcgtggcagatcgagttgataaaagcctgcttcattttttcgctttcttgcgctttacggttcagaactttcagctccgctttcattttcttttctcttttcagagagaagtaaagataactacaaaccccgatcacaataatcaataaagtgcttaaagatataatctgcgtctttttgttttttatttccagttcagccttttcgttgttcagtgtgtttacatcatatttcacctggagttcattcaactgttgacgtgcgtcattagtgcttaacgaatcttgtatgtaatgcgagtttttgtaaaacttcagagcatttggataatctttttgtttctcataaagctgggaaatcgtgttcaacaaccccggtaagttttgtggagccagagtcctggcaaatttaatgagagtgtcattcgctgcaatagcttttgacaaatccttgtgggtccggctattcgtataataattattggcacatagataatagttgtacttatcaaagtcgttggtcagattcttgccgatctgcagaatccttttccaataatagttttcttcttccggcgttagtatatccagattacttatcagaaacgaataatattgcatccgataggagccaatattataaaacggacgttgcttctgatagtctcttttgtattcctgttctaccatattgattaactcttttattaactgcaccgcttcccgtcttctatcactcttggcgtatgccatgctcaacttccacataattcttttctgatacttactcttcacattggcaggcagtgattccgccaatttcaggcttttctctaaataaggagaagcctctttgtgtttctgatttgcgtaaaaactagttcctacagtgtatgttgttgcaatttctttataaatattacttgtattttctttggaattcatcaaatccaattctttttcaatggcttcatctttctggtcggagaaactttgcgcttcgaaaatgcgcatgtggtattgaggtaacaggctttggaattcttccggactgactatcttcttgatgtaattgatatatttagagagagaatctttattcaagatatttacttcttccgcaataatatcatcgagggcattcaaagcatattctttattgttaatctttaaggcttcatgatacatctgtagaagatacatctttgcttccggagcatccaaatatatatccgccagatttctgcatatctgaatcttttgaggagaagaatttgttgacttcagaagatgtatgaggctgtcgctggggtgttgagacgcatttattgtaaaacatagtgagggtataattataaatatgataagtagtaggtgtcgcatggcatattttgttttgtttgcttgcaaatctactatttttttttattaaatccagctagttgaacgaaaaacttttggagcaaaaatagatacagaaatatccgataagtcagtagctataaagaaatgataactactgactttcggatattctcaatgcctataataccttgttgattttaatgtatggatgccttccatgctttggcatattcttccaaaacacatttgatactttgtccgattttcacataatcggcctcattcaaattggctagtgacacacgcacactccatttcggtccggcaaagccaccgccattcaacaggacgagtgaagtttcgtttgccaggcggaaaaccacatccaatggattgtaggtcttttgcagataagcaacgaagtcatccccatagaatttcttcgcccataccagcatgtcgatctccgaataatatccggcacgtaacggatcttccaccagcgtgaaacctgtgttatcccacaacgcatgcagacgacgatgaataatttcctgcatcttcttcttataactgtcttctttatccagaagcgagaagatggcaaacaaactcatctgtatttgttgaggtagagaaagccctgcagtatgattcaatgcaatctgccggctgtcagccaccatacgattgataaatttcatcttttccggttgtagactaagactggaataacgtttgttcaagattgatttttgctcctccgacaggcgggcaatcattttgtcgtagatgttgtcttcgtgtagagcgatcactgctgttctccatcctgtagctccaaaatatttggagaacgaataaacgcaaagcgtattatgcggcaactctgccattaatgaacggaaatgaggaataaatgttccgtacacatcatccgtgataatcatcaggttcggattatcattcttcacaatgttgatgatacgttcggtagtctctttactaagcgcataactgggcggattactcggattggtaataaataatgctttgatccgcagatctttcagcttgtctatatcttcatccttatactgccaggtatgtaaaccgtcaggagtcatctggtcagcagaaatttcggtcacgtcgaactgatagcgtcgcagttccgggatttctatataaggagtgaacacaggaaccatcaaagcaatggcatccccctggttcaacaggaaattctcttgcaaagaatcgaacagataacacatggctgccgtacctccttcggtcgcgaaaaggtcaaaagttcctttcggcggacggcggtcacacatctcttgcgccaggtaatcttgtacgattaactccgtaaaatgtaaaatacggtcgggcacaggatactggtcgccaatcaccgattccgcccattcgtgaataagcgtatccggatcggcagcatgttccatcagcatataattatagccctctttcaacaggttagcaccgggagctttctcgttttctttcaggaaagcctcgaaacgggcagcaattcccgccttttgcggaatacctgctattccttcttccagtgaaaacgcatgacgacattcgcaaaggccgaattgtcccagcagaaaaaaggcttcgcgtggttcagtagcaatccagttcgggttacctcttccggcattcaacatcgtatgtgctatcttcttgatactttcatctgccatatcgatcagtttgtttttcagctcgaacgggctgatcgtttccattttcttggcataacttttcgtaatggcagggttatttgttttcttttccataatgatatttatttagttagttttacataagtagtacgatgacgactccccagataatcaggagcgtattgccgactgcatacgtcaccgtatatcccaatgccggtgtgtcgctttccactgcatcctgaatagctcccaatgcagctgttgtagtacgtgctcctgccgtacatcccaatgacagggcagggtggaatttgaacaagtatctcgccatcagcaatccagcgaggagaggaatggccgttgccaatgcgccgacgataaacagactgacgcctacttccttgaatccggcaatgaaactgggacctgcagcgataccgaccactgcgataaacatattcagtcctacattattcaatacccataaagaaggttcggggatacctccgaaagtaggatgcttgctgcgtagccaaccgaacagaagtccggctatcaatgcgccgccactggtagaaagactgataggaacacctcccagatgaatagccagtgcaccgaagagaccaccgagcaaaatacccaatccaacgaagatcatatccgtctggttggtaggccggtcaatatagcccatttgtttggcagcactttccacttcatgtttaagaccggtaagttcgagaatatctcccgaatctacaatcgttttgggcaataccggaacattgattccggcacgtttgatattccggatactaaccccgtgcataaatttctgtgccctgattttggaaatcgtttctccggcaaaagtccggtgggtcaccattacaggaagagtttctgccgggaagtcgagtaattgtgcatcaatcacttccggaccgatccagtcttcttctccaatcacaaattcacggcgtccgctaagtaccacttcgtcattcttatgaagaatcaggttcggatctacttccttcaccactcttttttgacgaatccgttctacaaacagccgtttatcattcttacatagataagcttcgagttcactgactttctttcctttgccaaaccattcattggtgattttataagcacggaatacaaccggacgaagagccggggaaaatccgggttcatcagcttccgatgttcccatttgagcctccaattccttgcagtcggctttcaccttatccagtccacccagcattttagggccgagagaagccagaatccacgccgaaccggccgttccgaaaatataagttacggcatacgctaccggaattgcattgatgaacgtggctttctgtgcatcgctgattcccagctggttgatcgtatcgcttgccacgccgataacggcggatattgtttgtgagcctgccaacagtccggcagcttctcctacatgatatcccatgattttggccagtatccacggggctaccagactgacaatacacatcagtacggcaaatcccacttgtggcagaccatctttcttcaatccgcggaaaaactgcggacctaccttatagccaacggcaaataagaaaagcagaaagaacacagctttcatcggaccatctacagtgatattcagttgtccgaccaatactccgaccaaaagaacgctggtgactgtccccaaggagaatttccctattttgagtctgccaagccagaacccggcaaagagcgtaaggaaaatagcaagttcaggatgtacccttagttgattaataatccattccataattaagttgttgttttaggttatgctatttacaacagttatcgcgtgaaaagagtttgttgtgttatgataaatatccggtgaactttaaatttctctatttcgcttttttgttatacttttgttccttcaaaaataaaactaatcatattctgtatgaaatcagacatagaaattgctcgcagcattgagctgaagaagattaagcaggttgccgaaggcatcggaatccctcgcgaggaagtggagaattatggccgctacattgcaaagatccccgaacaactgattgatgaagagaaagtgaagaaaagcaatctcattctggtcactgctatcacagcaaccaaagcgggcattggcaaaactacagtatctatcggtctcgctctgggattgaataaaattggaaaaaatgcgattgtagctcttcgcgagccgtctctcggtccatgtttcggaatgaagggaggagcagccggtggaggatatgcacaagtgcttccgatggacaagattaacctccattttaccggagattttcatgccatcacttctgcccataacatgatttccgccctgctcgataattatctctatcagaaccaggcaaaaggtttcggattgaaagaaatcctttggcggagagtgctcgatgtgaacgatcgttcgttgcgcagcatcgttgtcggcctcggacctaaatccaatgggattacccaagagtccggtttcgatattactcctgcttcggagattatggcaattctttgcctttctaaagatgtgagtgatctgcgtcgccgtattgaaaacatcctgttgggttttacgtatgacgaccaacctttcacagtgaaagatttgggagtggcaggagctatcaccgtgttattgaaagatgctatccatcctaatttagtgcagactaccgaaggaaccgctgcttttgtacatggcggtccgtttgctaatatcgcacatggttgtaactctattttggccactaaactggcaatgtctttcggcgattatgtaattacggaagccggattcggtgccgatcttggtgcagagaagttctacaatatcaaatgccgcaagagcggactccaaccgcgtctcactgtgattgtcgctacggcacaaggattaaagatgcacggaggtgtcagtctcgaccgtatcaaagagccgaatatggaaggcttgaaagaaggattgcgcaatctcgacaaacacgttcgtaaccttcgctcattcggtcagaccatcatcgtagctttcaataagtttgcatccgatacggatgaagaaatggaattgttgcgcgaacattgcgaacagttgggagtgggcttcgccatcaacaatgcgttcagtgaaggaggagagggagcagtagatatggcccgtctggtggtagataccatagaggataatccgtccgaatctttacgctacacttataaggaagaagatagcatacagcagaagattgaaaaggtagccactaatatttacggagccagcgttattacttatagcagtattgcccgcaaccgtatcaaactgatcgagaaaatgggaattactcattatccggtttgtattgcgaaaacacaatattcattttctgccgatccaaagatttatggtgcggtaaacaacttcgagttccatattaaagatattgttatcaataacggagctgaaatgattgtagccattgccggagaaattcttcgtatgccgggattacccaaggagccgcaagcattgcacatcgatattgtggatggagaaatagaaggattgagctaaaataaatccccgtctttccctatgaaataaaatgtggaaagacggggatggctgtatatagagtccagtgcgcttctgttttctcttcttgcacactgtacggttgaattcgtccttgctatgagtgatatatatcatcatatatttcttttatagtaagaaaaacgaaaatccggacagatggttcggacaggaccgttaataaataaaaaaaagcctgctcctttcacaaagagcagaccttataaataagagataaagctgataacagtttgaagctattagctttaaaatcgttttttaataagcaaaaagaggatatttcttcattgtctcattgacacgtgcacgtacttgtgcaataacttcctcattttctacgttagacaatacagtctcgatcatttcagcaatttcgagcatcaagtcttcttttgcaccacgggtagtgatggcaggagtacctaaacggataccggaagtctggaaagccgaacggctgtcaaacggaaccatgttcttgttaacggtaatatcagcagaaaccaatgctttttctgccactttacctgtcagttcaggatatttgctacgcaggtcgaccaacatagagtggttgtctgtaccaccggaaacgatagtaaagccacggtcaatcaaagcctgtgcaagtacagcagcgttcttttgtacttgtttagcatattccttaaattcaggttgcaggatttcaccgaaagcaactgctttagcagcaattacatgttccaacggtccaccttgaacccctgggaatacggcagaatccagtaattgagacatcatcttgatctcacctttcggagtggtcttaccccacggattggggaaatccttacccatcatgatgacaccaccacgaggtccgcgaagtgttttatgtgtagtagaagtgacgatatgtgcatatttaaccgggttttcgagcactccggcagcgatcagaccggcagggtgagccatgtcgatcatcaggatagcgcctactttgtcagcaatttcacgcatacgtttgtaatcccattcacgagagtatgcagaaccaccaccgataatcattttcggtttctcgcgcagagcgacttcttccatctggtcgtagtcaacgcgtccagtttcctgattcaggttatattcgcaaggagtatagatgataccggaagtgtttaccagtgagccatgagaaaggtgtccgccatgtgcaagatttaatcccatgaatttgtcgcccggattcagaactgcgaggaaaacagcagcattagcttgtgctcccgaatgtggctgtacgtttgcccattcagcgccaaaaatttctttcaggcggtcgatagcgatttgttcgctttggtctactacttcgcaacctccgtagtaacgtttgccgggataaccttctgcgtacttgttagtcaggcaagaacccattgcctgcataacctggtcactcacaaaattttctgatgcaataagctcgattcctttcaactgacgttgatgctctttttcgataatgtcgaaaatgatgtcgtctcttttcattcttttataagtaagattaaatttctaattcgagatacctattttaagcgcacaaagttaatgaaatcaaaggataattgacaattgccccctgacaattgacaatctttaaacattcaaccctttgaaccgccactctttatttttcaattctcaattttcaactctcaatttatcaaaggatgaatcccagcgaaaaacttaacgcgctgtcacggcgacggaaaataatgttgctcactcccgtgctgccgtcggaattgatattgtcgtaaatgatggacttggagatgtttccgatgccttgctcgtagcggaaatcgaaaaagatacgggagatgttgacgcctacaccgatcactgcactggcattgaacggatacagcctttcgtgaatccctttttggtcaaaattcttaaaagtgatttcattgtgttttccccataagtagcgaagtttggggcctgcgaagatagacattccgtaaggcccttttttcaccacattatagccgtataaaatagggaaatccacactgtgcaacaccgattgcacggaagcataatcaggctcgatggcaggatgctgcgaaccgagcttatcgaaagtgatctcacatttgcttacattataggacacttccggctgaatgaaatgcttcttcatgttgatgcgcataaagagggcgccgaaataacctatcttgtagttattctgcacctcatcgatagttacatccttaattttcagttcagacaccatgaacatggaagagttgaatcccgccttgataccgatatttattttttttgtattggggcggtctactttttctgcgttatagttctggccgacagccgtgcaggctatggctaacaaaccgggaaggatgaatttacgcagcatattcatggcaatatcgcactttttatgatttcttcttttctacactccaaccgaatttaccgattttctctcccagattataatatcctccgtgcacatataccagcggattggcttctgccagttccagctttccggtttcaggattcaggttccggtcgtccgcacgcacatttactacgtcagcgataaacatatcgtgtgagccgagagagatgatttctttcacacggcattcaatgcagagaggagattcttcaatcaacggagcactaaccaccgtacactgtccgggtgtcagcttcatctcatcaaatttatgataatcacgtcccgaacgaactccgcaccagtcggtggcaaaagccatatctttcgttgtcaggttgatgacaaactccatattttttttgataatgtcataagaatggcgttccggacgtacggatatataacacatgggcgggtttgtacaaatcgtacccgtccatgctactgtgaacatattatattcgctttctccctttccgcagctgaccagtacagccggcagcggatagatcatcgttcctggtttccagtcctgtttcataggcctatacgtttattcagaggattgtaatctcttcacgtttctgctctttctcgcaataatggcattttacgatacagttatccttgtctatcacatgaaagatagtggccatcggttcgttgttggtgatacatttcggattggcacatttcacgatgccacgaagttcatccggcattttcacctctttcttttccactacttcgtaatcgcggatgatattcagcttgacgtgcggggcaactactgaaatacggttaatctcttcgtcgcagaagaatttatctgcaatcttgatgatcccttttttacccagcttcttgctgtcgaggttgaatccgatagtgatattgctagtcatctgttccacaccgagcagttgcactacggtaaagagcttttcggatgggatatggtcaatcactgtcccgtttttcagggcagctacttgcaatgcttgtttattttcgctcataataaaatatcgtttttaacgtcatctaatgtgatacctaatacatcgcaaaggattgcttcgcgggcatacagaccgttttgtgcctgttggaaataatatgctttcgggttgtcatccacatcgtaagcaatttcgttgacacggggaagcgggtgcaggatacgcaggttcggacgtgtgttctccagcattttgttacggagaatatatacattcttcacccgttcatattccatcaggtcggtgaaacgttcgcgttgcacacgggtcatgtacagaatatcggcgtcagcgataatctcttcggtaaaatccgtatgttcaacgtattttatttggtgcgttttacagtaaagcttgtattcttccggcattttcagctcttcgggagcgatgaaatggaaagtcggattaaagtgtcgcatcgccatcagcaatgaatgtacggtgcggccgtatttcaagtcacccaccaggaaaatgttcagattttccagcgttccttgtgtcttgtagatagagtagaggtcaagcatcgtttgcgacgggtgctgattggctccgtcacctgcgttgacaataggcaccggagctacttcgctggcataccgtgcagctccttcgagatgatgtcgcatgacgataatatctgcgtagttgctcaccatcatgatcgtgtctttaagtgtttcccctttggaagagctggtagctttggggtcagagaatccgattactcgtgcaccgagacggttggcagctgtttcaaaactcaagcgggtacgagtggaaggttcaaagaacagggttgctacaacctttccttgtaataaccggcgattggggttcatttcaaactgcttcgccatttcgagcatgtagaggattttttctttagaatgttcggcaatggttactaaacttctgttttccattttgttatcttttatgtggatagaacttgttttaccggagcgtaaaggtacgaagaatttgtgaaaagcacagatttttcgtaccttttttatcagcttttaatcagtcggtttatttccgtccgctagctaacgctgcaatgatatatttccccggtgctccgattttgctccaggctgtattggagagcagtttccacacctgggtgcctttcctgccatagtccgatagccggagaatcgtctgtttctcttttgggtcggtcactttatggttgtccaggctctccatcaatcctgctatgttgtgtgtagccagattgtaggcataccccggaatttcaatcgaagcaacgttggtttcttcttcttcatgatttagtttagtttcctttagtttagtttgtcgggaaatgtctgcatttttttgattcacctcctcttgagtttcaaaaatgtctgcattttccgcgttcaactcttctttttgcatcccttttttcttcttggtctctaataaataaggtagttgggagaaatctattttccttcgtgtagtggcttcgaaccacaccctttgaatctgttccgaagtgagtatgccgtatttttcgtaggtttccttatggaaaaatcctttctccaataacagatcgacaatcttttccatcatatcctctttaatcccgccgcctactttgcggacaaaaatcaggttttgttcctttccccaagagatataatatccctctttatatattttacaaagcaatcgcatgacaatgtaagaagctaacactccaaatttagcttctaatagttccatcacttcttcgtcaaagaagtttgccggtgtcgggaaataaggtatccctttgttaatcatattcattgttaaatatattataatctgatttatacaatagctctccactccatcaggttcccgatcataaatcttctccatcctttttgttcttcactccaatacacaatagactcttgttttgctgtaatattgaattctctatgaaagaatttttcatatcccaccagcgttcctctttccaggcagaacgtaccatcctgcttgtgaaaagctatcattacattcccatacaacatgcgttctattagtttaatgcactcttgtacaattctctccgcacatttatccgaaatccccttttcagcagtaatacgttttttccatactaatttgcaaatttctaacttgctcttcctgattctttgtctcattttcttctgtttttaattttgaaaaataaatttctgtttgagtgtaaatctcccctttcagatagtgacgctatgctattgtcatagcgttactatcctctcattatagtgacactataacaatagtatgccgtcactattttttcaagagaaatactttttgtttttcgaccggttgaaaacggcggcgaaggtaagccttatatttcaactgtcccattatttttttcttagtacttgcttttgaccttttcagcctgtttccttttttcctctttctctttcatgtattcttcttcgacaggctttttcaatgccgccaattcagcatgtatactgctaaattccatcaacttatagccatcgtgtttgtgaatgtataatactttttggtcatagatatattgggccatatttatcaacttttttttcttgggatggcggaaatgtccatcgataaagatttttaaatacatggtgagataaaggcggatatctccatcgattgctattctgttatccagctcttcttcactgatgatttcttcctttgaatgtcttccgggggcttttcccactgtttgaacatttctttttgctttgtcgtttttactaccttttttagtttttttactgctcataattaattaatttttgcaatattaatgaatgttaattagaaaataatatctggaaagcggaattaaacgtgcaaaaagatttgttcttttgtcgcttgccaaatagtatatatataaaataactagtgatgcaaatgatgaataaaaatggatttagtcgatgtggtgagaactacatcaatcgtttacgaaaggaggggcgctattctacagcgcatgtctataagaatgccctttattctttcagtaagttttgcggtacgttgaacatgtcgttcagacaggtcaccaaagaacgtttacgacgctatggtcagtatctttatgagtgtggtttgaagcccaatacgatttctacgtatatgcgtatgcttcgtagtatttacaatcggggagtggaagcgggtagtgccccttatgttccccgattatttcatgatgtctatacaggcgtggatgtccgacaaaagaaagctttgcctgccggtgaattgcacaaacttctgtatgaggatcccaaatcggagcgtttacgtcgcacacaaactattgccgccctgatgttccagttttgtggaatgtcattcgctgatttagcgcatctggaaaaatcagctttagagcagagtgtattacgttataatcgaatcaagacgaaaactcctatgagcgtggaagtgcttgatactgccaggggaatgattaatcaactccggagtaatcaggaacccattcccggttgtccaaactatctgttcgatatactttgcggtaacaagaaacggaaggatgaaagggcataccgtgaatatcagtctgctcttcggagattcaataatcgtttgaaggatttggcgagagctctgcgtttgaattctcccgtttcttcttacacacttcgccattcttgggcaacgacagccaagtatcgtggagtgccaattgaaatgattagtgaatcattgggacacaaatcaataaaaaccacacaaatctatttgaagggttttgagctaagagaacgtacagaggtaaataaagggaatttatcttacattaggaactatcgtttaggtagataattaacggtaaagtattagaaatcaagggcgaaatgtttctgttacttcttaggtaacggataattattcggtgcaaagatatgcaaaaatacaaatagtaaacaagtaaaatcttcttttttttctgatttgttgaaatatgcaacaaaaatatatcaggacatgatggttttgttttatcatgcccgatattcctatattctgttttcaaagatgcttttcccttcgcgtaggttagaaaaacattgctgtaggcggttcttgtccatgtttttctgttttcatctgttttcctgtgaatgagtaccttatccgttacctaagaagtaacggaaacataaggggtaaaaaagtatgattctaacgaaagaaactttaagtgctgggcctaaaattgggacaggggaaggcgtagcacactctaaacgctggtatgtcgctctggtccgtatgcatcatgagaagaaggtagccgaacgtttagacaagatggggattgaaaattttgtaccggtccagcaagaagtacatcaatggagcgaccgccgtaaagtggttgaatccgtgttgcttcccatgatggtttttgtgcatgctgatcctaaagaacgtaaagaggttctttccttttctacagttagtcgttatatggtaatgcgcggtgagagcagtccgactatcattcctgatgaacaaatggcccgtttccgttttatgctcgactattccgaagaggcaatctgtatgaatagcgctcctttggcacgtggtgaaaaagtatgtgttgttaaaggtcctttgactggtcttgtaggagagcttgtcacggtggatggcaggagtaagattgctgtccggttggatatgctggggtgtgcttgtgcagatatgccggtagggtatgtggaaccgattacatattagcgtacattctttatataaactggctctctgttttgatagaggggatagcaaagaaaagataactgatcaaaagtagactaatagtacaatcaacaattttctgtgcggtatcttagaaaagagaatggcttcatttgagcactaataactattgagtacttattgttaaactactattatatgtctcaagctttagataataataagcgaatagcaaagaatacgatgttgctttactttcgtatgatttttttgttggcgataagtctttttacgagtagaataatattacagactttaggaatagaagattatggtatttataatgttgttggtggtgtagtgactatgttcgcatttctgaataatgcaatggctggagcaacacaacgctttttaagttttgatatgccaaatgatgataagaaagtcttaaatactacatttagcacatctttgataatacatttaataattgcttttattattgttattctttctgaaactataggtttatggtttttgtatgaaaagatggtgattccaacagaacgtatgaatgctgccatgtgggtgtttcaatgctctatttttgttatgttcgtaaacatcattagtgttccatataatgcggctatcattgctcatgaaaaaatgggagcttttgcatatataagtttgctagaagcggctttaaagttaattattgcatattctctttatatatctccttttgataaattgaaagtgtatgcaatccttcttttggctgtcagtctgattattcgttttgtatattcatcatacagtaataggcattttgaggagactcattttcattggacttggaatactaacaaaataaaagaaatgggaatgtttgctagttggagtttaattggaaatttagcattgatgggtgttactcaaggattgaatatgctattgaatgtattttttggtcctgccataaatgctgctcgtggaatagctgtacaagtacaaggagccgttcagcagtttgctaacaattttcaaacagctatcaatccccaaatcacaaaaagttatgcttctaatgattttacatatatgcattcattaatttgtaaaggagcaaagttttctttttttatggttttcctgctatcattgcctgttttagttatggcagatcaaactttatcattatggctaaagacaccacctgcttatactgcggtttttttgaaaattatattgattgtctctatggttgatagtttggcaaatccgttaaataatgcagtgaatgcttcggggaagatacgatcgtatcagttgacaaatggattacttatgcttatggttttacctgttggctatttagctcttaaagtagacttgaatccgaatcttgtgtttatttgtcaattggcgatgactgtttgtgctctattttttaaactcttttttgcgaagcgacgaacacggctttcattaggactatatgttaagaaagttttatatccagtgatgttagttgctattatatcgccaatattaccgtacttgatgtatacatacatggaacataatgtaagttcttttgttgttactggttttttatgtttgttttctacatcagttgctatttatctattaggtttagaaaaatcagaaaagactgtcattatttccaaacttatttcactcactcgtaaaattcatttatgaatgaggaactatcttttgggattttaattttctaaagcagtagataaaaacatcaaatattaagatgagaaactttttggcacttgtttgtttgtttattatattatattgcaattgttgtctttttgagcaggctccatatccattttattataatagcttcataaatgttattccagtagctttatatttagttttatatcggacaaaaacaaatttcaagatagatataaagtggatagttctctcctttatatcatttactttaatgaccttgatttggggaagaaacaatgggagtacaactcttcttttgtttagtttcatgtttattccacagttcttcagatcaatacaatcacaggaaaatgcaaaatatcttattatttttttattcgcttgtgaagctggactttgtatttatgaatacgctatagaaaataatgtttttatggcaatttctacgattacagatagatctagattccgttctacgggactatgggcacatcctctgcataatgcctctattgtaagtgttacaatactcttaattataatgagtaatctaaaattatcaagaaagatactcctgctgatcattggaattattgtactttttacttttaatggtagagcttcaattatatcgacctctatatgcactttgttgattgtcttacaaaatcctagacaagtattcaagattgtacgtaaacatccaattctggtcggggctactataataatgggtatagtgctatttggatatctctcatcgacagatttgggtggaaaaatgttcaatgcagaaacacgcaatatggatgacaggagtgccggtgcacgatttgacctttatgcttatgtacttaacatgaacattgaagaatggctatttggctttaaaaattttgatgcaatatttttgcgtaacgatttcgattatattgaaagtacgcaactttctttaatcctaagtatgggggggctgatagctattccttttatgatatttcagtttattgatctatatcattattttgacaacatgcgtcctcggtataggcttataataattcttgatatagttgtcataggacttagttcggaaagttttgttgggcttgcttcgtgggttatgatatatgcagcttacaccgctttatttggaaataattatataaaaaggacaatatgaaaataggtattctcacttttcaagcatctcataattgcggatcgatgcttcaggcttttgcgttacaatacatcatttcgcacaagtatcatcatgaatgtgaattgataaactatgcaaattcagcctctagaaatatgtatgggctaattgattgtcgcatttatcgcaatgttttcaaggaaaattggaaacgtcttacgcatttgaaaacatatctcaattcaatgaaagagtatgaagagttttcaaacaaatatttggtgctaagcaaaaaggatctatccacaagaaaacaactcggagcaatagcttccaattatgacatgattattgcaggtggtgatcaagtatggaatgtgtgttgtccagatgcaggaaaggaattttatctgaattttacccacgatgttcgtaaagtatcttattctcctagcatgggtggtcaaaacattcttatcaaagccgacaatcttgaggtttataagcaattactttctgaatttgaacatctatccattagagaacctcatgggcaacaatggttgcaagagctaacaggaagagaagtcaagattgttgctgatcccacattgcttttatcatccaaagaatggtgtgaagtgcttcctgttcctgaaattgaggagaaatatatctttaattatgcattctatcataatcgtgaagcgacaaatcttggaatacaagaaatttcaaaaaaaactgggctacctgtctatacaatagactttaaacaacatgctgtatatcgattagaccagtatggcattaagcgttataaacatactggaccgttggctttccttggtttaatgaaaaatgcgtctttagtacttacacagtcgtttcacggtacattgttctctgctttgtttaatcgtttgttttggtcgtataattgggaaggtatgcacaatcctgatgacgatcgagctatagctattttgcgtcagtttggcttagaagagcgataccaaatgatagaagatattgttaccatggataatgtgttggaaccaataaactatgtacccgtgaatcaacgcattcaggaattgcgtaatgatgcgtttaattatcttcaagactgtctgaaataacaaatacaatgggagaaccgaagataactatcataattccagtatacaatacagagaactatttgaggaaatgtcttgattccatcttgacccagcatgaacaatcttttgaggtgatacttgttgatgatggaagtaccgatggctctggaattatttgtgatgaatttgcgcagtctgatagtcgttttctagttgtacacaaacaaaatggtggtgtaagtagtgcacgtaatgtcggattggaaatggctgtgggaaaatgggtggcgttcattgactctgatgatgagatttcacctgattttcttactatacctattcaatatgaagatgcagatattatccagaaagcagatatatgggtttattcaaatggggtaaaaataaaaaaaactgtaatcaatgatcgttatttgacttcacatcgtgaggtaggtaactattggattaatagaaccaataactaccttgcagtcagattgattgcgagagaatgtatcggagatacacgttttttgataggagtgaaaatttctgaagattttctttttttcacctctatattgcataacgtaaatcgatatgctttttcatcagttggacattattactactaccaacgagaaaattctgcaatgtacaaatttaaagatgatatacgtgaggatattcgtattacattcgaacatttaaatattgtacgaacatatgagtgtcattctaatatggttgagatatgtgaaaatttagtgtttggttattttatgaaaacattatggaggcgaaggaggtatttaacaccagaagaaagaaagtgttttaaggcaattctatctgaaatgagactaggttctttatcattatgtaaacccaaaataaagttaggcatgatgatagtaaagatcataggtcaatatattatgtaatcatagcctatggcgaaaatttctattattgttcctgttttcaatgtggaaaaaatgctgccacattgtttagacagtataaaagcgcaaaccttctctgattttgaatgtttgcttatagatgatggtagtacggacagttctggcattctttgtgatgaatatgtggcgtttgacccacgattcaaagtcattcattcagaaaatcaaggagctagtgcagcacgtaacctagggcttgacaatgcaagtggagaatggatacaatttattgatagtgatgattggatagctccggatttcttgcaaaactattttaatatagggaatggttatgacatcatatttcagggtattacaattgagaaaaatggtaaattacaagaattgactattaattccaatagtggtgaaaatacgatagaaacaattagtaggtttgaacagaacaacgttcttggatggtgtattaataaaatttttattaatacacttattcaaaagtatcacattcgtttccctaaaggaataactattcgagaggatcttatatttactttgagctatcttcagtatgtatcagctataggcataactcctaaatgtgattatcattatgtgataagagatggttcgttgatgagtagacctcgatcttacagagaagttgatgaatgctgcgagttgatttttaaattgcgaagaaatttagttgaagtaaattttaataatcaatataagaattggtttgaggaagaatacgcaatgagaaaactaatacaattgaaatatatttattatcctcaaactatagtttctagagacgagcgatattcttttttgaaatcagctaggggatataagctcaagaatataaaattaccgaaaacggatagagttatcttttatttatttcactcactattgccattttttataaaagataggctgataaaaattgttgcgttgacgtattataaaagtcattataagaagaaatgaaacagaatccgaaactatctattattgttcctatatataatgtagaaaagtacttagatcaatgtattcagagtttatttaggcaaacgctgagaaatattgagattatcttggttgatgacgagtcgccagatacctgtccgcaaatgtgtgatgattatgctagaaaggatgaccgtgtaaaagttgttcataagaaaaatggcggcttaggttatgctcgaaattcaggacttgcagttgcacaaggtgaatatataacctttcttgattcagatgattatgttgacgatgatgcttatgaaatactttgtagtttagctgacgagaaccaattggatatgcttcggtttaaatgtaaccggtttagagataatggtgaagcatcagtagcaaggtatgatgcaccatttagtgtatattcatctaaagaagagataaggaaaattgctttgtatttatttgattcaactgataggtatttatctaatgataaaattccaacaggggggagctcatgtatggcaatttatcgaggtgcaataataaacaagtataatatcaggtttgtaagtgagcgggagtacataagcgaagactacatattcaatttccaattttaccaactgtcttgtaagattggttatttacccaattcttactatcattatcgggttaatcctaatagcctaactcgtgggcttcaattggataaaattcataaggcggaaatttatacaaattacataatttctttgattttgggaaatgggtatgatgaaaaaaatactgtatttgctttcaactattatttaggtatggctcgaggagttaccaagaatgtctttgtttctagtttgtcacttctagaaaagaggaaatggtttttaaaacaaatgagtgatgcttatttccaggaagctagtgcaaagtatcctgtagctactctaccttggaagcaacgtttgtgtcaatggggcatgaaacatcgattatttttcttttgctattttcttcttatcatatttaataagataagaagaaatcaatataaatagtcactagaaagactagagatgaaagaggttctaatcatcatgatttgggaataacaaaaaactatgtgtttcacattctctaaagcataacttctgtaatcttagaacaagctattatcactatttaactatactgtaatttgagattattgtaaaggatgaatgcggaaaatattttaactataggtattgattatcgtattgtacatggtggtgtggcggctgtggaaaatgtgtatagcactttttacaagccatttaatcatgtcactactgtggtagatggaggacaagtgaataaattttttatcttatgtagtgccttctttcaatttttcggatggatgctgtttcgacctcaaatagaaatcgtacatgtgcatggagcaagtaatgctagcttttggcgcaaatgtatttttatttatatagccaagctgtttggaaaaaaagtgatttttcactgtcatggtgctgaatttcaaattttcactatcaaacacaggaaagctgtaatcagaactttgaacaagtgcgattgcattattgcgcttagtaaaagttggaagttgtggtttgagaatacagttcatcacaaaaatgtggtggttatcaagaatgttatcgctcctcctcatattaataaaaaaaagaatgataagtttgtcatacttttctttggacgtttgggcaagcgtaaaggcatttatgatttattagatgttttgagtgaacatcgtgaagaatttcttaacaaactagagttcttgtttggtggtgatggtgatgtggagcaagtacaagctatcattaaagaacaaaatttgaacaatattgccaaatatcaaggctgggtgagcggcataaagaaagaacggttgctcaatcaggcggacgcctatattctaccatcttataatgaagggttgcctatatcagtgttggaagccatgagctattctttaccgataatttccactaccgtaggtggtattcccgaaattttaaaaaataatgaaaatggtttcatcatggaaccgggagataaaattgctatttatcatgcaatatcagaattgatggcaaatgaggctatggcgaagcgtatgggtaaagattcgttaagtaaagttcaggagcatttaccagactatgtggtgaagcaattacaaacactgtacgattctttagtataaatacaattttaggatgaggtatttgtctaggagtatcgataaaagtttatataaataacatccgacaatcatgataaagaaatatattgaagagtctttgaagtatcttttgcgcactcgtttgttcatccataaatatgtggatgaaattaatgttatgtatgacatgacatcggaagagttaaaagcaagaaacgagagacgttttttggaaatattcagaaaagcgtattctaagtctaaatattatcggggattatgtcttgcagaagggattaagtcaattgaggaaatacggtatctgaaagatattgtaaaattaccaattcttactaaagatatactgaaagctcatggggaggaattactgacccgtccgaaatggggtttgataaaaagtcatacaagtggaacaacaggaactccgctcactgtgtttcaggattgggcatcggtgtggcgagaacaggcttactttgtttgttatcggaagcggtgtggatataactatggtgaaccaatggtttctttacgtggaaatttggggagaagtgaaatatctcttaagatacatgtaagcaatacactttttctttccagttataatatcaatgaacagatggcgataacttattatcggttgatagagcatcatcatgccaaagcgatagagggatatccaagttcgctttacaatttagctttagttttgcgtgataaaggattcgaatgtcatattccaatagcgtttacatcttcggagacattgcatgactatcagcgggcgttgattgagaaagtatttaatacacagatttatgatcattatggtaccacggagcgaagcatccgtttggaggaatcatttaatcatgatggatattttgaagaccctggctatggtatagaagagtatcatgatgattatgtgatttcaacatcacttatcaatgatgtgtttcctctgatacgatataaaactgatgaccgtattgttttaaaatctgacactgttaagacaaaagagtgttttattgattacatacaaggtcggaatgatgattgtctcatctgtaaggatggaacgaaaatcgtgcgacttggttttgttactaaggactttgatgaaatagacaaaactcagtttgtgcagaaacagaaaggtgatgtggaaattcgtattgtatgtagccgaactctctctgaagaagtgaaagataaagtgaagaaaaatttagaggatagatgtgggaaagggaatatggatattgtagttcgacaagttgatgataatgaaattatttattctagttcacttaagtttaaatatgtatattctgaaatagggaggggatcgaatatcagttaggtattattctttagtctgatagatgagaagatatatcagaaaaaaactgaatatgaatattcaacagattgataagccagagttgaactacacaaaacgcaataaactggctttagtcattagtaatttataaatctcaattcaaataatcatgaacattagtatttttggtctcggctacgtaggatgcgtaggcgcggcatgttgtgccaagcttggtcacaaggtgattggtgtggacgtaaacgagaacaaggttcgtctgatgaacgagggtaaacctaccattattgaggaaggcattgccgaattgtgtaaggaagcccacgacaaaggactgatgtcggctacaactgtagctgctgaagctgttgctcaaacagaggtgtcgtttattgtagtgggtactccttcaagcaaagaaggacatttaaacctaaattatatctatacagtggctggacgtatcggtaaggctttgaaggagaagtttgctaatgaaaacgcccctaaaaatatgcacttgattgctattcgttctactgtacttcctggaacaaaccaaaaggtgggtgagattatcgaacaggaaagtggtttaaaaaggggagtacacttcactgtagtgagcaatccagagtttctgcgtgaggggacgagtgtggaggactactttaacccgccattgactttgattggcactgattctgaatacgcagagcaagtgttccgtgaaatgtataaagatattcacgctgagtttatttgcactgatataaaggtggctgagatgatgaagtatgtcaacaatacatatcatgctttgaaaattgtgtttggtaatgaggtgggtaatatctgtaaaggactggatattgattcacataaggtgatggagattttttgcaaagataaacagttgaatatttctccatactattttaaaccgggatttgcgtatggcggttcttgtctgccgaaggatatgaaggcgttgaagacattggcgcatgatttgtatgtggatgtgcctgttattaacagtattttccaaagcaacgagatacagaagcacaatgctgtgcagatgattatgagcaagggacaccgtaatattggtatcttgggactgagtttcaaggcgggcaccgatgatttgcgatgctctcctatcgtggatgtggtggaaaacttactggggaaggggttcaatatccgtatttacgatcgtaatgtaaaagtgagtgaattgactggtacaaacaaggactttattatggcaaaaattccgcatttgcagcattttgtaacagatgacttggatattgtgtgcagaaacagtgatgtgttggtagtcactaataaagagaaggattttgcagatgtgttgaaaaattatccgaataagattataatcgacttggtacgccaatggaaagaggtggattacaatggtcaatatgaaggtctttcttggggtaatattaatactaatgagggacagaatatggagtatgtggaggattttaaacagactgagttttaaatgagcaaatgggcttggtatgtgaatcgcctgaaagctatgaacctgcaggaggtaatctggaggttggagcagaaaaagattcaaatgaaagagaaaagaaaatttagtggttgtaaggtggctgtgtcttcttttcgcttcaacaaggcgctggaaaaattgaggtttgactgtgatgcactggggatttactttggtaatcgtaattatagtgtgaatacttccattcatctgctcggtgggtatgattataactattataagaaggattgggccgccggttttcaaacgaagaattgctgggatggcgagtttagctactatctgaactataagcaacgagatgatattggagatgcacgtaccaattgggaactgaaccggcattttcagtttgctttgttagcaaaagactattttgtgagtggtgatcggcagtatgctgactcgttagaggaattgtttatcgattggaatgagaagaatagttttttacatggtatttcatggacaagcgctatggagattgctattcgctgtattcagtggactattgctcttagttttcttcaaaaaaaaggtgatattctctatggaaaattgatggagaatatggagacgggtattgtaaacatgacggattatctttgcaatcactactcacgcttttcatcggctaataatcatttgttagtagaagcagctgctattgctctgtcagggtttgtttttcatcatcaggcatggcagaaactagctgttggcatactgtcggaggaattgccaaagcaaaattataaagatggcgtaaataaggaattgtctctgcattaccagacatttggtatggaggcttacggtatcgtagggtgttgtatgttgcataatggcgtatgtctacctgatggatggaaagaatggttagggaggatgtgtgagtttgtaagtcactgttgttggtgtgaacaggcagtatgtgaatttggagataatgatgaagggaagattgtggacttggttggggaacataccgatcattataattatgtgttacagttgctttcattggtattagggatgcgctatcatagctttgaaaaggtgactgaaaatgtaggttggtggtttagttctgagtcgattgaccggataaaatctttgcctatatatgacaattctcgaagccgttgctttagtgaaggtggtaactcttttttgagaagtagcgatggaagtatattgataggtatcgaccatgcggcactgggatttggcactattgccgctcacggacatgcggatgcactgagttttcagatactgaaagacggaaaaagaattttcatcgatccaggtacttatatctaccattgtcagatagaggaaagaaatattttccgtcggactgatcaccacaatacggtgatgatcaatggggaagagcaatcgcaggttttgggggcttttctttggggtaagaaggcggaaacgaaactgttgtcgtattcgttccaagaagatgtagacgaacttatggctagtgtcacggggttgtgtagtgtggtgcacacgcgtacatttcgttttggacgatctgagggggtactactgattaacgaccgtttcgataaggattgcgattggacggcatctttcgtgatagcaaaggattatgaactgtcggtgtcagatcgtagggtgacatgtgatgcatttacattggagtcgcatgaaggagaaatacgaatagaggatatttttgtatcggagcaatatggtataaaagagaaatccaaagtaatcaggatcagaagccactcgaaaagtaacgatatcaaaattagtatcaatttattatagaacatcattatatcttatggatagaaaaattttgattgttgtagagaacctaccggttcccttcgatacacgtgtatggcaggaagctactacactggctgcaaacggatacactgtatcggtgatttgtcctattggcaaaggctatgacaaagaatatgaatttttacaaggagtacacgtttatcgccacaaattgccgaaagatggcaatggagctttgggatatgcacgagaatatgggactgctctgtggcatgaatatcgtttggctaggaagtgttacaaagaggttgggtttgattgcattcatggttgtaatccgcctgatgatatttggatgattgctcgtttgtttaagaaaaagggagtggactatattttcgatcatcacgacatttgccctgaattatatgaagcaaaatttggaaagactgcaagtatgttctataaaagtcagctatggctggaacgtcagacttacaaacattgcaaatttgcttttgttaccaatgaaagctataaaaaaatagccattgaacgtgggggaatgaaagcggaagatgtatttgttttgcgtagtggtccgaaactggagcggttgaagatacaagaaccgaaatcagaaataaaacgtggaaagaaattcatggtgggttatctgggtgtgattggacagcaggaaggcattgagtatttactgaaagctgcaaaatatatcaaagagttaccaggacgtaacgatgtgttttgggggattgttgggggtggtcccgacttggaacgtatgaaaaagctttgtcatgaaatgggactcgatgatattgtcgaatttgcaggtcgcgtaccggatcagaaattacttgactatctgaatactgctgatgtgtgtgttaactgcgacgagtacaatgccatgaatgacaagagtaccatgaataaggtgcttgaatatatggcattgggtaaacctttagtgcagtttgatctgactgaaggtcgatattctgcacaagatgcttcactttatgccgagcacaacgatgcgaatgatatggcaaggaaaattctagagttgcttgataatccagaaaaacgtaaatggatgggtgagtatgggcgtaatcgtgtaatcaacgaattgggatgggaacatactagtaaagctttgcttgaaggatatgacagatactttgggagtagggggaaatagagatgataaatgcgataagattatataggattgcccgttggctgtatttgcatcatattccttttttaccgaaattattgcagcttattacttttctaatgtataattgttctgttagttataaaatgtcaattgggagagggagctttttcaaccatgctggtataggggtactgataaatcccaaagttgtcattggtaagaattgtaaaataggtaacaatgtgtcgattgtggggcaaggaccttataaggaatgtcctaggataggtaataatgtctatataggttcgggtgctgtgatacaaggtcccgtaatcatagaagataacgtaattgttgctcctaatgcggtggtgaataagagtgtgcatactaatatgatagtaggtggcattcctgcaaagattattggcgatgtgacaaaattggattatgatatttttgcaaatgaatcgtggaaagaggggcacaagccatttttgacatgataatatttgcctattgtaaacatttgatttgaatatcttaaaaccctaagttttgctattgtaatttgagacaatagtattatggctaatttacatcaatcataggaaacatttatgcaagaagtccaacgtttcaacaaagtcctaaaatctttggtccttttgggggatcttattttgctgaacctgcttttatggggatttaatttgtttctgggtacccgtttttggtgtatccattgcggttctatctttcagggtatgactcttatcactctgtgctatttactttgtaacatgcattcgggtgttattcttcatcgtcctgtggtgcgtcctgaacagatcatgattcgtgttttacgtaacatggttccttttgtctttttttcggtttgtatgttgctcgtttttcattttcatttttctcattcccgttatttcggattattttatgtcgctttaataattgttattgtcagctatcgtttaatttttcgtcactttttggaactctatcgaaaaaagggaggaaatgtccgcaaggtcgtattggttgggagtcatgagaatatgcaggaactttatcatgcgatgacggatgatcctacatccggttatcgtatactgggttatttcgaggattttccttcggaccattatccacaggaaattccatatttgggacaacctaatgaagtgactgtttttttggaaaaacacacgggagagattgaccagctttattgtagtcttccttctgtgcgaagtgcggagattgttcctatcataaattactgtgaaaaccatctggtccgtttctttagtgttcctaatgtccgtaattatttgagacgtaggatgcattttgagttaatgggtaatgttcctgtactttccattcgttgcgaaccattggagtcattggagaaccgtattatcaagcgtgcttttgatatcgtttgttcagtgctgtttctttgtacagtattcccgttcgtttatatattttttggaattgcgatcaagttaagttctcctggccctgtctttttcaagcagaaacgtagtggtgaagatgggcgtgaattctggtgttacaagtttcgctcaatgagggttaatacgcagtgtgatattcttcaggctacggaaaatgatcctcgtaaaacacgtatcggagagataatgagaaagactagtgtggacgaattaccacaatttataaatgtactaaagggtgatatgtctattgtaggtccccgtcctcacatgttgaagcatacggaggaatattctaatctgataaataagtttatggttcgtcacttcgttaaacctggaataactggctgggcgcaggtgacaggttttcgtggtgagacgaaagagctctggcagatggaaggtcgtgtgcagcgtgatatttggtatatagaacattggacttttttattggatttatatatcatgtataagacggtgtataatgctatacatggagaaagagaggcatattagataatagagaataaaaagacgataataaaaaacttaggaattaaagggcgtttaattatgaatttacgaattatgatgagaagacttaacaaaagaaatttgtggctactattgctgccattcctattggctgcctgtcagtcttataaaaaagttccctatttccagaatgtggaagttgtgaatgaggtagaacaacaggaaaaattgtatgatgccaagatcatgcccaaggacttgttgaccattgtggtgtcatgtaccaatcctgaattggcgataccctttaacttaacagtagccagcaatgccggaatagctgtgagtacttcgtcttatgtgactacccaacctgtattacaaccttatctggtcgataatgacggaaacataaattttccggtattaggagaattgaagttaggcggcttaacgaaaaaagaggctgaacaactaattatagataaactgaagccttacatgaaggagacccccattgtaacggtccgtatggtcaattataaaatatctgttatcggcgaggttacccgtcccggaacttttactatttccaatgagaaagtaaatctgttagaagctttagccatggcaggtgatatgacggtatacggtcttcgtgataatgtgaagttgatccgtgaagacgcaaacggcaaacagcagattgtcaccttggacttgaataaggccgaaaccattctttcgccttactattggttacaacagaatgatattatttatgtaactcctaataaagcaaaagctcgaaattcggatgtaggtaacagtactagtctttggttctctgccacctctatcttggtatccattgtcagcctattagtaaatattttaaaataatgatttgcaatgaaagaaacagatttcaacgaagcacaagaatctaaggaagaaaatatagacgtcaaggaactcttgtttaaatatctgatacactggccctggtttgtgggtgcagttgtggcgtgtttgattgcggcatgggtctatttgtatatatccactcccgtgtataatatttccgctacggttctaataaaggatgataagaaaggtggtagtgccggaatgctttccggattggagagtctgggattggatggtatgatttcttcttcgcagaatattgataatgagattgaagttcttcgttccaagactatcgtcaaggaggtggttgaagatttgggactctatatttcttatgcagacaaggatgagtttccttccagaaacttgtataagacttcaccagtacaagtgagtctgactccgcaggaggctgacttgttggagaaaccgatgattgtagagatagcattacaaccacagggaagtctggatgtgaatgtgaagataggtgatgatgaatatcagaaacatttcgaaaagttaccggctgtttttcccaccaataaaggaacacttgctttctttcagacactagattcaatattaccttctaagaaatcatcagaggaaatagtgggtgtagaaggaactgtacgtaatattacggcagtgattaataagcctttggctgtagcgaaagggtattgtggaagtatgactatcgagccgacttccaaaaccacttctgtggctgtcatatcattgaaaaattcaaatgtacaacgtggcaaggattttatcaataagttattggagatgtataatatcaatacgaataatgataagaatgaggtggcgcagaaaacagcagaatttatcaatgaacgtattagtattatctccaaagaactgggtagtacggaaaaggatctggaaagtttcaaacgtggggcaggtattacagatttgaccagtgatgcacagatagctttgacgggtagtgctgaatacgaaaagaagcgtgtggagaatcagacccagattaatttactgcaagatcttcagaagtatatgcagaacgaaggttatgaggtcctgcccagtaatattggattacaggatgtgaatcttgcagctgccatcaatcgttataatgatgtgcttgttgagaggaaacgtttgctacgtacatcaacggagaataatcctaccattataaatcttgataccagcatcggtgcaatgaaagagaatgtccaagtatctttagacagggtattgcgtggattatatatcacaaaagctgatctggatcgcgaggcaagccgttattcccgtcgcattagtgaagcacctggtcaggagcgtgaatttgtgagtattgcacgtcaacaggagatcaaggccggactttatctgatgcttcttcagaagcgtgaggaaaatgctataactttggctgctacagccaataatgcgaagattatagatgatgctatagcagatgatgctcccgtatctcctaaaggtaagatgatttacttgattgctttagtgttaggagttggaattccggtaggggttatttatttgctcgaattaaccaagtttaaaattgaaggtcgttctgatgtagaaaaactcaccagtttacctattgttggtgatatcccattaaccgatgaaaaacaaggagctattgctgtatttgagaatcaaaataacctgatgagtgaaaccttccgtaatatccgaacgaatcttcagtttatgcttgacaatgataagaaggtgattttggttacttctacagtcagcggtgaaggtaaatcttttatctctgctaatctcgctatcagtctttctttattgggtaagaaagtagtaattgttggtcttgatattcgtaaacctggtttgaacaaggtttttaatattccgagaaaagaaattggtataactcaatatttggccaatccggaaaagaacctaatggatttagtacaactttctgatgtcagtaagaatctgtatattcttcctggtggaacagttcctcctaatcctacggaattgttggcccgtgatggattggataaagcgattgagactctcaagaagaattttgattatgtgattttggataccgctcctgttggtatggttaccgatactttgttgataggacgtgtggctgatctatctgtttatgtctgtcgtgcagattatactcacaagaatgagtatactttgattaatgaacttgctgaaaacaataaactgcctagcttgtgtactgtaataaatggtttggatctgaagagaagaaagtatggctattattatggttatggtaaatatggcaagtattatggctatggtaagcgatatggctacggttatggatatggagaacaatctcataccaaggaagactaaagtcattaatggctgatattttttaagttaataatgtcatagagtacttttaatactttacacgaaagtgagatggaacatgtaggtccctaacttcatgctacacacatgaagcccctacattttgtggtcaggaaatgcacagcggtgtattcctgatcaacgccctcatgtcggtgtaaatccgatgtgatttctattatatcaactgtctgtgaagatagttgatattttttttgtaaagcaatgactgatggataatttttagtagctttgtgaaaaatatgattgatatggaagatttgcaaagattatatcctatcgggattcagacattctcgaagatacgggaggggaattacctctatattgataaaacagcatatgtttatcggatgactcattcggcttccagttatatgttcttgagccgtccacgacgttttgggaaatcattacttacttctacgctgcatagctatttttccggacgcaaggacctgtttcacggattggctatggagaaactggagaaagagtggacggaatatccggtacttcacttcgatatgagtaccgccaagcatgcggatagtgaacagttgctccaagagttaaatctgaaattgtatggctatgagcagatttatggacggctggatgaggaggttaatcccaatcaacgtttgatgggattgataaaacgtgcttatgagcaaaccggcaagaaagtggtcgtgcttattgatgaatatgatgctcctctactggatgtagtgcacgaacgggaaaacctggatgtattgcgtaatatcatgcgtaacttttacagccctttgaaagcttgtgatccttatttgcgatatgtatttctgaccggtattaccaaattctcccaacttagtattttcagcgaactgaataatattgagaatatcagtatggatgagccatacgctgctatctgtggaattagtgaggatgaaatacgttctcaaatggaagaggacgtggacagattggcgaagaatttggaggttacactggaagaagccttgatgaaactgaaagaaaattatgatgggtatcactttacttatccgtcacctgatatatataatccttttagtttgcttacagctatggaaaagggtaagattggctcatattggtttggtagcggtacgcctacgtatctaataaagatgttggataagtttggtgtgaaaccttctgaaataggacgtaaacaactaaagtcttctgctttcgacgctcctactgaaacgatgactgatgcagtgcctttattataccaaagtggttatatcactattaaggattataataagatgctagatctttatacgctggatattcccaataaagaagtaagactgggacttatggagagccttcttcctcattatgtagataacaagacacctgaagcaactaccatggtggcatatcttttttatgatattcagaatggtgatatggatgctgctttacaccgtttgcaggaatttctgtctacgattccttactgtgacaatacaaagttcgaaggacactatcagcaggtattttatatcatattcagtttgttgggatattacgtagatgtggaagttcgtactcctcgtggacgggtagatatagtacttcgtacaaagactacgttgtatttgatggaactgaaattggataaaagtgcgggtgaagcgatggagcaaattgatttgaagaattatccggaacgctttgctttatgtggattgcctgtcgtaaaggtggctgtcagttttgatagcgaacggtgtacgattggagactggaagattataaatgcttgattatatcattgatttataagtcgctatatacttgattgaatataaagagctccgtaaggggcttttttcttttctatccggaataaaagcttcacctttgcatcgttgatcaacaaaacgtgaataaataacttgaatttaaatcttaaaaaaacgtagtatgagtgtaatttacaaagtcattacgcgaccaacagatccgcgtgttcccaattctcctaagagatattatccgcatctgatcactttaggtcagtccgtcaatctgaaatatattgcacagaaaatgcaggatcgttcttcgctgtctgtcggtgatattaagagcgtaatccagaattttgtggaaaaaatgaaggagcagttgctggaaggtaaatcgataaatatcgaaggcttaggtgtgtttatgttgactgcccgttcgaaaggtgcggagttggcgaaggatattaatgctaagagtgtggatagtgttcgtatctttttccaagccaataaagagttgcgtgtcaccaaaactgctacccgtgcagatgagaagttagacctgatcagtctggatgaatatctgaagaaaattagtgttactgtatctcccacaaatcctgaaaaaccgggtgaaggcgaagatggtggagatgatggcgatgatagtggagaggcacccgatcccgcagcttaatgtcttgttgattaatagctgacggttagagtgttcatttaatgtttaatttaaaaagagaaatgtctatgaaaaaaacgtggagtattattttgaaagtgattattgctgttgccggtgcgattgccggagtggtaggtgtgcaggcagcaaccttgtaattgattatcttataaataggtatatttatgaatgaataacaggcgggatttttcccgcctgtttgtgtttagatataataagagagctacacttcttcacatactctcatttccattcctttatatactacaacaatcttatgcaactgtgtggtgccaatagcattttttactgtatctgtatcagcataacggttggtttgagcgattccttctaatcgtaattcatccacacgattttccggatctttgtatttagcatatttcaactcgattatgtaactgtgtttcatatccggataaatatctaataatggagataagaagatgtcagcatatccttcttgtgtatctgcttccgaaatagggcggtagaaccggttttgtgcagtcatggctaatgtgaaaccatgtacgaaaaattctcccttttgcttgtcgcgttgggaggcatagcgtttcagacaatcggctatatagtcaaaataagctttccaggtacctcgataagcaagcgagctggataattcatttttctcataattactgaagcttaagttggcctcattgtaagtgttcaacaaataggtgtaaagttgttcgcgcactacttgattgggaatggtgagtttgcactttccttcatgtgcgccactaatagtaagcatgccaaaataatagagtaggcttgtgaaattgtctggatcaataatactggcggctggaaatccttttttcacttctccagtgatgtatccttggcttactaaggtctgtatgatggatgcatcgtgcgcaaactctttatctttacgaatgagcatacgcaatttttcgtagtcaatacggatgttgtcttctaccatatctttcggtatttcaccgttatattcgatataatttttgacgaaataaagcaccatattggaattgtacatcgtagttttaccatagcattcctgtgcaaaacagtaattgtcataccatggtttcatgatttctatcaactcattgatggtatgattgaaatgccctgtattagaataataagttaacatttcgcgaacctcactttctgtgaatcccatcatttcgttgaatcttggtgacagtgagtagttagtaccgatattgaagccgctggtcaagtcatccattgtcacgggactgacaccggtgataaaacaacgtttaatgctggagtctgtgccggattttattttattgaagaaagcacgtaaataaccttctttgtgtgtctcatcagtgtaacggtttaagctgtcgacatcagagagtattgtattggtgaaatggtcgtattcatcaatgaagagataaatcttttgatttacacgggcgcactccgtaaacagatattcgaattggctgacggctccgtctttttcgtccattttttctttgattccttcaggtaagtagtcagcataaacatcacagaaatagtcaaatacgattctacaatgttcgtccagacctttgcggtagctgtgtaaatctccacttattcccgagaaatttaattttattaccagatagctattacgatcctttgtgggatgctttccaatataaagatcgccaaacaaagcgtcaaacttatctttggcacgtacatcataataatgttgaagcatattcaaagtcagactttttccgaatcggcgcgggcggataaaaaagaaaaaacgatctgattgctctatcaaggggatgaaagaggtcttatccacgtaataataattgtccaaacggatgtcctcgaagttcatcataccataaggtaataacttcctgtctgatgatacgtatttcataattaatgtcttttatatgaatgcactttgaataagtgtatacaaagatactttctttccgctattttcccaaacaaacgttctttctttttgtttcgtgctatttgttaggagtatcgctctatattttaacaaaatagaaattataatcaaactcgttggctgaatagcggattttatctacctttgcatcttaattaaatgcgtcattttaagcgagaaaaaacatgattcgaaaaataataaaagctctttggatattcttggcagtcatagtattggctattgttatagtctttgtctccatttcaaagggctggattggctatatgcctcctgtagaggaactcgagaacccgagctataaatttgcaacggagattttttctgaagatgagaaagtgcttggtacatggtcttacagcaaggaaaaccgggtgtacacggcatacaaggatttgtcacccagtattatcaatgctcttattgcaacggaagatgttcgttttgtcgagcattccgggattgatgccaaagcattgttccgtgcgtttgtgaaacgtggtttgatgtttcagaaaaatgcaggtgggggtagtaccttgtcgcaacagctagctaaacagttgtttacggaaaatgtggcgagaaatacacttcagcgtcttttccaaaaaccgattgaatgggtgattgcggtgaaacttgaacgttactacaccaaagaggaaatattgagtatgtatctcaataaatttgattttctgaataatgctgttggtatcaaaactgctgcatatacctattttggctgtgaaccgaaggacttgaagattgaagaagcagctacattggtgggtatgtgtaagaatccgtctctctacaatccggttcgtttcaacgaacgttcacgtggtcgtcgtaatgtggtgctcgagcagatgcgtaaagccggatatatcacagatgcagaatgtgattcattgcaggctcttccgttgaaactgacttataaccgtgttgaccacaaagagggattggctacttatttccgtgaatatctccgcggcgtcatgacagcaccgaaaccggtaagaagtgattatcgtggttggcaaatgcagaaattctacgaagattctatcgcttgggaaactaacccgttatatggctggtgtgcgaaaaacaagaagaaagacggtacaaattataacatctatacagatggattgaagatttatacaactatcaattcacgtatgcagcagtatgccgaagatgctgtaaaagagcatttgggtgattatctgcaacctgtattcttcaaggaaaaagagggaagtaagaatgccccgtatgcaagatcactaccggaaaaacgagtggaagagttgttgacgaaagcaatgaaacaaacggaacgttatcgcctcatgaaagaggcgggagcttcggaacaacagattcgtaaggcgttcgatacgccggaagaaatgactgtcttttcctggaagggtgataaagatacgattatgacaccgatggattccatccgctactacaaatctttcttgcggacaggatttatgtcaatggatccggcaaacgggcacgtgaaagcttatgtgggcggaccgaattatgtatacttccagtatgatatggcgatggtgggacgtcgtcaggtaggttctactattaaaccgtatttatatacattggcaatggagaacggattttctccttgcgatcaggcacgccacgtagagcagactttgattgatgagaatggaactccctggacaccacgtaatgcaaatgataagcgttatggagaaatggtaactctgaaatggggattggcaaactccgataactggatttctgcatacctgatgggtaagctgaatccgtatgatttggtacgcttgatccatagcttcggtgtacgcaataaagcaattgatccggtggtttcactttgtctgggaccttgtgaaatttctgtcggtgaaatggtcagcgcatatacggcttttgccaataaaggaatccgggtggctccattgttcgttacccgtattgaggatagtgatggcaatgtcatttctacttttgcaccgcaaatggaagaagtgataagcgcgtcaagcacttacaaaatgttggttatgctgcgtgccgttattaatgaaggaacgggtggacgtgttcgtcgatatggaattaccgccgatatgggtggaaaaacaggaacgaccaatgataactccgatgcctggtttatgggattcactccttcactggtatccggttgttgggtaggaggtgacgaacgtgatattcacttcggtagaatgacctatggacagggtgctgctgcagctttgcctatctgggcgatgtatatgaagaaagtgtatgacgatccgactttgggatatgaccagcaggagagattcaaactccctgaagggtttgacccgtgtgccggttcggaaactcctgatggcgaagtggaagaaagaggactggatgatctgtttaattaagtattaagtatagtgctatttaatacttaatacctaatacttaatttaaatgcacaagtatattgtttgcatagggagtaattacaacaggaaagagaacctgacttttgccaggcagaagttgactgaatcgttctcttctatatgttttgctcccgaactggaaactaaacctttgttttttaagaatccggctctgttttccaaccaagtggttctgttctattccgataaggatgaagagacggtgaggaaaatgttgaaagatatagaacagaggtccggacgtcgttcggaggataagaaagaggaaaaagtatgtctggatattgacatgcttttatatgataacaaaatattaaaaccggaggattggcaaaggggatatatacaacagtcattatctgctttccattcttcattatttattaagtagatgaaatttcttggaattatacctgcccgctatgcatccactcgttttcctgcgaaaccgttggctatgttgggcggaaaaacagtcatacaacgcgtatacgaacaagtggcaggcgttttggatgacgcttatgtagctacggatgatgaacgcattgaagctgccgttaaagcattcgggggaaaggttgtgatgacttccgttcaccacaaaagtggtacggatcgttgttatgaagcctgtaccaagattggaggtgattttgacgtcgtagtgaatatacaaggagatgagccttttattcagccttcacaactggatgcggtaaaggcttgttttgaagatgtaaccacgcagattgctacgttggtgaagccttttactgccgatgaaccgtttgccgtactggaaaacgtgaattcaccgaaagtggtagtcaacaagaactggaacgcactttatttcagccgttctatcattccttatcagcgtaatgccgagaaacaggactggttgaagggacatacctactacaagcacatcggattgtatgcttatcgtacagaggtgctgaaagagattaccatgcttccacagtcttctttggagttggccgaatctttggagcagcttcgctggctggagaacggatacaaaataaaggtcggtatcagtgaagtggaaactattggaattgataccccacaagacttggaacgggcagaagaatttttgaagaatagaatctaatcttatggatcgtacgatacaacctgaaatacaaaccctgaaaaattttcgtatacttcctcccgttcgaatgacgttgccaaacggtattccgttgactgttattaatgcgggtgaacaggaagtggtacgcatagatgtactttttgccggggggcgctggcaacagtcgcagaaactgcaagctctgtttacgaaccggatgctgcgcgaaggcacgaaaaaatatacggctgccaccattgccgaaaaactggattactacggctcatggctcgaattgtccagctcgtcggaatatgcatatatcactgtttattcgttgaataagtatttggcgaaaacattggaggtggtggaatccatgattaaagaaccgcttttcccggaaaaggaattgcataccattctcgataccaatattcaacaataccaggtcaatacttccaaagttgattttctggcacaccgcagtctgttgcagtcgctttacggcgaacagcatccatgtggtaaaatagtagtggaggaagattatcatgccatcactccggaagtgctccgtgaattttatgaacggtattatcattcgggtaattgctctatctttttgtccggtaaggtgacggaggatattatcagccgggtgacagatatattcggcacttctttcggtcagcatcagcagcaggtgtcgagattaagttttccttttactgctgttcccgaaaagagaatttttacagagcgtgaagatgccatgcagagtgctgtgaagatgggatatacgaccattactcgtaatcatcctgattatttgaaacttcgggtattgatgactttattcggaggttatttcggcagtcggctgatgtctaatattcgtgaagagaagggatatacttatggtatttcggcaggaatcatgttttatccggatagcggactattggctatctcgacagagacggataatgaatatgtggaaccgttgatacaggaagtgtatcatgaaatagaccgcctgcatcaggaacctgtgtcagccgaagaattgactattgtacgcaactatatgttgggagaaatgtgccgtagttatgagtcgcctttctcactttcggatgcgtggatcttcattgctacttccggtctggatgatgactacttttcacgttctctgctggctgtgaatgaggttactccgatggaaatacaagatttggcacagcgctatttgtgcaaagagacattaaaagaggtcattgcaggtaaaaagttgtcataatttgctttccgaaagtgggctgtttgggatagaaattgtatctttgtccaaattgtaattctaaaatgagtaacgactaaaaccaatgaggaaatatctatatactacacttttgctggctcttcttgcacaagagggagtgatggcacaagaaaatgaaggaaaaaaaggcggatttttcggaaaaattaaagatacattctccactgaaataaagattggcaactatacttttaaggatggcagtgtctatacgggagaaatgaaaggacgaaaaccgaatggaaaaggaaaaacagtctttaaaaacggtgatgtctttgaaggagaatatgtgaaggggaaacgtgaaggatatggaatttatatgtttcccgatggagaaaaatacgaaggacagtggtttcaggaccagcagcacggaaaaggtatctattattttatgaataataaccgttacgacggtatgtggtatcaggattatcagcatggtgaaggaacaatgtattatcataacggggatttgtatgtaggtaaatgggtgaatgataagcgtgaaggcgaaggtacatacacttgggcgaatggtgccaaatataccggtcactggaaaaatgataagaagaacggcaaaggtatcatgaactgggacgatggctgtaagtatgaaggagattggaaagatgatgtccgtcacggaaaaggagtatttgaatataccaatggagataaatacgatggtgactgggcggatgatattcaacacggaagaggtacttactactttcacacgggcgatcgttatgaaggttcttatctcttaggtgaacgcaccggtgaaggagtttattatcatgctaacggagacaagtatgtaggtaatttcaaaaatggcatgcaagacggaaaaggtacttttacctgggcgaatggtgctgtgtacgaaggaagctggaaaaacaataaacgtgatggcagaggagtctataaatggagcaatggcgatgtttatgacggtgattggaaagacaatcgtcccaatggacagggtactctgaaaaccgttgctgggatgcaatataaaggtggctttgttgacggattggaagatggacagggcgtacaaattgacaaagatggtaatcgcttcgagggatttttcaaacaaggaaagaagaatggtccttttgtggaaacagataaagatgggaaggtgattagaaaaggaacctataagttcggaagacttcaatagatgataggtgatagatgataaatgatagtgggctgcgcattgcgtggcctcttttttatggtacaaagaaaaatggataataaccaaaagcggtcattatccattttataatttcctgttgaaagtaacttcaactatcaattatcaattatcaattatcatttgtcacctatcatctattaaatgatgtattgtgaactgatagattcgttattcatcactcgtttgattgtttctgcaaacatatcagcaatgcttaattgttttactttcgggcatttctttgcgtaagggatgctgtcggtaaataccatttcggttagggcagactcttgtacacggaaagaagccggatcagacattacgcagtggctggcgatggcgcgtacagatttggcaccggcatccagcatgatgttagctgctttggtgattgttcctgctgtgtcaacgatatcgtcaatcaatacgacgtttttaccttctacgtcaccgatgatttgcatagatgctacttcattggctttttcacgtgatttgttgcaaagtaccaatggtacaccgaggtatttggagaaagtgctggcacgttttgaacctcctacgtccggtgtagcaataaccagattttccagttgcaatgactggatgtaagggaggaatacagctgatgcgtacaggtgatctaccgggatattgaagaatccctgaatctggtctgcatgcaagtccatcgtaatcaggcggtcgatacctgcaacagacagcaggtcggctaccaacttagcgccgatagatacacggggtttgtcttttctatcctgacgtgcccatccgaaataggggattacagccacgacgctctttgcagatgcacgttttgcagcatcgatcatcaggagaagttccattaagttgtctgagttagggaaagtggattgaaccaggaatacgtgtgcgccacgaattgattcctcatatgaaactgcaaattcgccatcggcaaaatgggtaatgttcatatttcccagaggacaatccaggcttgcgcagattttttctgcaagatatctcgagttcgttcccgagaataccataaagggtgctttttcgctcattttgtaatagatgttacctatttgttaatttgcctgcaaaggtaggaatttctcttattatttagaaggacttattgtataaaaaatatttttctctccaacttatcggaaatatttgtagatttgctttctgaaaacagttaatagtcaaaaatgagttcacgctttcctttatatataataggtatagtgttgtttgcctcttttttttcgtgcactgatatggtgccgactaaagaggtgcgcctgattgattcattaaacgggaaagcgtatgcttatcgttatcgaagcctggattcttcttataaatatgccaatgaagcctatcggcaggtgaatttctacaaatcggggaaagcggaagcatccaacaatctggggttttgtgcttttatggctatggactttgaccgggcggaagcgttgcataaggaagtatataaactgactaaaaatgaactcgaactgttgattgccgacatcggactgatgaaaatctgtcagcggacggctatgaacaaagaattttatgattatcgtaatagtgcgctcaagcgcatgaaacgtattcgtgaagagagtgatttgtttgccgaccgtcacgaggcactacggctggattatgcattcaccgaatttttcatcgtttcttctatttattactactatctgcagcaacggcaggaggccatcacatctctcaaccggattccggaagatgaagctttgacagatactaatcagttgctttattatcattatattaaaggttcggcttcgttggtggaagcaaccaagccggaagaccggaaaatgcgtgagttcgaccaactttatattacctggcggacggctgttcagactaatcatccttatttcgaaggaaatggtctgcaaggattggctaatctgatggtttcacccaataatttcgaacttttccggacgagaaggggatatgcgctggatcagtttgggtttcccgtagattcgcttttgcctttgcgaatggcacagcgtgcgcttgaaaaatttcgtgagtacaatgatttgtatcagattgccggtgcgtatgtgtctatcggtaaatatatgaatgagcacggacgttatacggaggcattggatacgcttgcaaaagcgttggattgtgtgaatcaacatcacatgctctattatcaccatgcggcggatacattggataaactacatgtttttgtagaaggagatacgacttataccggggttccatggatcatgcaggaagatgtaagaacggtacctgaatggatctcaaggattcgggagcaattgagtgtgtcgtatgcggggctcgggatgaagtatgcttctgattacaaccggaatatatatttggatattttgaattatacccgtcaggataaggagttggagagccgctatctttcattggaagccgattcacgacaaatgacgcttgtactttctttggttattgtcggacttgtactggtggttattctttggtgggtttttaataaacggtctaaaataaggaatcaggtagacgtggagcgtctgcaacggattctgattctttgccgggacattacttcgtctattccgatgaatgttccgttaattcaacaaggtatcgatcaattgtttgggaaaggacgtctccaactggaaattccggaggaaggaaaagcggcgctggttcctctgcatcggttgaaccgtgatgagaaagcattggtgcatgtgcttgaaccgtatattgtttgggctgcagacaatgagcagatggtagaagcgttgagtgatgagcggatgcagttagaaaagcaacgatatgtttacgaacaacatattgcgggaaataaacgtcagaatcttataaagaaggcttgtctggccattgtcaatggaattaatccttatatcgaccgcatcttgaacgaggtgcataagttgacggagcgggggtatattgataatgcgaagattaagaaagagaagtatcaatacattgatgagctggtaactacgattaatgagtacaacgatattctggctctttggattaagatgaagcaaggaacgcttagcctgaatattgaaactttcagtctcaatgaactgtttgagttgctaggcaagggaagacgtgcttttgaaatgaaaaatcagaagttggaaattgaaccgactacggttatggtgaaggccgaccgggcactaactttgtttatgattaatacgctggcggaaaatgcccgtaaatatactccggaaggaggaacaattaaagtgtatgcccgtactacggaggatgcgtatgtcgagatctctgtggaggataacggaagaggtatttctgaagaggatgtggcgcatatcattggtgagaaggtgtatgattcccgtgtgatcggaatgaagaatgcagccgatccggaagtgttgaaagaaaacaaaggtagtggtttcggattgatgaattgtaagggaatcattgagaagtataagaaaacgaatgatttattccggggatgtgtctttgatgtggagagtgaactagggaaaggaagccgtttctattttcgtttgccttcgggagtgcgtaaagcgatgggggtattgttgctttgcttgttgcttccgttggggatggtttcttgtctgcatgatccgattcctcccatgttgcaggatggcgattcgattgtagtagttacggattctgcgtatgaggatttgctggatgtagcgtcggattatgcaaatgctgcctattttgctaatgtggatgaaaattatgagttggctttgcaatatatagattctgcgatgctttttctgaatgagcattatgaaaaatatgcgcgtccggatcgcccacatcggtatatgaagctggtaggtgagggaacgcctgctgaaatcagttggtggaacgaactgtttgattcggattatcatgtaattttggatatcaggaatgaggcgtcagttgcttttctggctttgaaacagttggatgcatatagttataataattcggcatttacggatttgtataagttgcagggagaggatcaaactctcgaagcatattgccggcagttggagcgttcgaataccaataagacggtaggaattattttatgctttgttttattgattatttcgttggtcggatattattttctgtacatgagaaaacgtttgcagaatcgtttgaatctcgaacaggtacttgagattaaccagaaggtgtttgctgcatctttggtgagaccgcaggaacaggaaaatgcagaggcacttcaacgggaagagagtacgcttaaagaaattccgcagcggattgtggatgaagcattcggggcggtaaatgaattactgacaattgaccggatgggaattgccgtttataatgaaacgacacaccggctggaatatgcttctcgtcccggacaggaaatgccggaaatggtagagcagtgttttagttccgggaaatatctttccgaacagcatcttcaggcaattccgctgatggtggaagcagggggcgagcatcaatgtgtcggtgtgctttatctggagcgcagagaaggaacggaacaggagacggatcgactgctttttgaactggtggctcgttatgtggctattgttgtgtttaacgcagtggtgaaactggctacaaaataccgggatatcgagtcggcacacgaagaaacacgccgggcttcctgggaagacagcatgttgcatgttcagaatatggtgcttgacaactgtctgtcgacgattaaacatgagacgatttattatccgaataagatcaaacagattgtagggcggttgaatgcgcagaatctttcggaaacggaggagcgtgaagcggtggagactatgacggaattgattgaatactataagggaatctttacgattttgagttcgtgtgcttcccgtcaattggaggaggtcactttccggcgtacggtgattccggtacaggaacttttggatgctgccggaaaatatttcaagaagttgatgaagaatcggccggagaggatagaattggaaatagagccgatggaggcgaaggtgataggagacgtgaatcagttgcgttttctattggagaatttgattgatgaagcattgactgtacgtgaagatggagtgatacgtctgcaagcacgcaaggataatgaatatgttcgtttcctctttacggatacgagacgcgagaagagtgtggaagagttgaatcaactattttatccgaatctggcacgtatgacttccggtgaaaaaggggagttgaggggaacggaatatctggtatgtaagcagattatccgcgaccacgacgaatttgcggggcgtaggggatgccgtatcaatgccgagccggctgaaggcggcgggtttacggtttatttcactattccgcgccgataaaaggaaaacacataaaagttattagataaggaacatggaagaacagaagtttaaagttattattgtagaggatgtaaaactggagttgaaagggacagaagaaatattccgtcatgaaataccgaatgcagaagtaatcggcacggcaatgacggaaagtgagttttggccgttgatggaggcccagcttcccgatctggtattgttggacttaggactaggaggttctacgaccattggtgttgatatttgcaagaatatattcaaacgttacaaaggagttcgggtattgatcttcacgggtgagattctgaacgaaaagttgtgggtggacgtattgaatgccggtgccgatggaatcatcctcaaaacgggtgagctactgacgaaaacagatgtacaggctgtgatggatggaaagaaattggtatttaactatccgattctggaaaagattgtagatcgtttcaagaaatcggtagccaatgatgccaagcgtcaggaggctgtcatcagttatgatattgatgaatacgatgaacgttttctccgtcatctggctttgggttatacgaaagagatgattgccaatctgaaaggaatgccttttggtgtgaaatcattggagaaacggcagaatgatcttatcggacgtctttttccgaatggtgaacgggtgggagtgaatgctacccggttggcagtacgtgcattggaattgcgtattattgatctggataatctggagcctgacgaagagtaaattgagtattaacggtagcttcttgcttagtcggaaaatgatgaagaataaatggcgcatgccccatcccgctacgatgttccttctgctgacaatggcagtggtctttctttcatggatatgcgatatctatggattgaaagtgacattgccgcagacaggtgaggatatccgtgtacaaagcctgttgagtccggaaggaatccgctggtggttgcggaatgctattaagaactttacaggttttgctccattgggcatggtgattattgctatgttcggattgggagtggcacaacattccggttttattgatgcttgtatccgcatgggggtgggaaaccggcaggaaaagaggaagatcatcttgtgggtgattgtgcttggcttgttgtcgaatgccattggtgatggtggatatatcattttattgcctattgctgctatgctgtttcaatgggtggggcttcatccgattgcagggattgtaacggcttatgtttccgttgcgtgcgggtatagtgctaatattgtattgagtacgatggacccgttgttggcgcataccacgcaagaggctgcactggcacaaacgggttatcaggggaatacggaacctctttgcaattacttttttatgagtgcttcaacggtggccattacggctattgtgtattggattactcaaaaatggcttcttcctacgttaggtaagtatgaaggcagtatgaaggtggtggcttaccatcctctgtctcgtaaagaacggcgtgccattatgatttccattgttgtggcagctatctatgtggctcttatcttgtggcttactttttcttcttatggaattttgcggggggtgaatggtggtttgatgcattcgccttttattgccggtattttgtttttgctttctttgggagcaggtattacgggaatggcttatggattcagttccggacggtatcgcactgacaatgatgtaattgaaggacttacgcagccaatgaagcttcttggggtgtatttcgttatcgctttcttcgctgcgcagatgtttgcctgttttgaatattctcatctggacaaatgtttggctatcatgggtgctgatctgctttcttcgtttgaaccggctcctttgtctgctcttgtcctgtttattctgtttacggcattgataaatctgattatggtatctgctacctccaaatgggcttttatgtcttttatctttattcctatgtttgcacagatgggaattgctccggatatagcacaatgtgcttttcgtatcggagatagctcgacgaatgccattactcctttcttattctatatgcctctggtgcttacctatatgcggcagtatgataagcagattacgtatggctcattgctgaaatatacttggagatattcattaggcatcctggttgtctggacattgctgtttattgtttggtatttgttgaaaataccgatgggattgtagggctaaggaatgattgccgggctccggtttatctgattggaattttgtttttctgaattaatcgctatatttgcaccgttccttaaagaaagacaacgaatgaatctaccagaaatctctgaaaatctaattgaacagttaaatcacggtaatacaaaagcatttgataaaatctatcatacctactacctttatttgtgtgcgatagctgtttattatgtgcatgacaagagggtggcaggggagattgtgaatgatgtctttgttgctttctggcagaatcgccatcacatcacttatccggctcttccgtatttgcggcgtgccattcaaaatgcaagtatcagttatctgcgctcttcttatttcaacgaaaaacagatgacggaacagatggaagaaatctgggcttttctcgaaaatcatattctttcttccgataatcctttgcaggcattggagcatagcgaaatgaataccatcatcatgaagaaggtggaggaattgcctgccaaatgccgtgccatatttaaagcaagtttgtatgagggtaagacatacagtgaaattgccgaggagcagaatattaatgtgaccactgtaagagtacagatgaaaatagcattgactaagctacgcgaatcactgggtactccttatatgatagctattttgatgtttctctaaaaaaaatcgcttttcttttaaacgtttctttttttattgcgtatctagttatatacacccatagaaaaagtacgtttatgaatgactcttatcatatagaagaattggaaatccggataagcaactatttgtccggtaactgcaccgaagaagagaaagaagctctgttcgcttctttggcttccaatgaagatgctgctaaaattttccgggagatgtccgcagtatgggctgtttcttctgtgcctgcatttgccaaagtagaggatgctaatttatcacagataaaagaaaaaatagccgctgctgagatgaaacctgtccgttcgcggaagatagttcctgtgtggctgaaggtagctgctgcaattattttgttgttgggttgcaattacttctggtacacttatactgaaaatcttacggaagtatatacgaatgcggattctgattatgaaattaaagtgccggccggttcgcggacgaatattgtgcttccggatggaacagaggtttcattgaatgcgggttctgtgttacgttattgccgtgggttcggtattcgtgaacgtgatgttacgcttgatggcgaaggatatttcaaggtggcgaaaaatgagaagattcctttctttgtgaatacgaatggtgtacaggtaaaggtggtggggactgtttttaatgtacgcgcttatgatgacgataattatgtaatggtatctttgttggaaggtcgtgtcaatttagccactttgtccggttcagtaatgaaactattccctagcgaacaggctttttacgataagaatacgggccgcatggagaaaatgaaatcaaatgctagttctgcctgtgactggttggatggtggcctgacatttgaggatgctccgtttgccgacatcgcacaccgtctggagcgcaaattccaggtgaagatcagtttagagagtgaacgtctgaaggcggaacgcttttccggatgttttaatagtaatcaaagtatcaatgatatattgggagaaatcaacgttgagaagcaatatacatggaaagttagtggagacactatctttataactgacaagaaaaaggaggtaaaataagaaaaagtaaagtatgattgggaacttagtcgatagatatatcggcggttcagcgttgtatagaaagatattatgttaacctttaatagtgaaaaatatgagattaatagtaaaaagaatattattaatgcttctgcttttgtctgtaggaaacgttttgactggtggtttccagctatcggcacaggaacaaagtaagcgattcagtgtgaaagtagataatattactttaaaagaagccattgaagtaataaagaagcaaggcaattactctttcctgattcgtaataatgacattgatttgaataggaaagtctctgtgaatataaataacggtactattaatgatgtgatgggacaattgctggccggtacggacgtcagttatgaagtgaacggaacccgggtgattatgttccatgcagtgacaccgcagaaagaacaggaaaaagcgtttgtcttaaaaggcagaatcactgatcctacaggtgaaggggtgattggggcaaatgtgaaattggtcgattctacggaaggtaccattacggatatggatggcaatttctccttgatggttactccaaatgcccgtttatccatatcgtatatcggctatgccacacaggaagtggtggtgaaagatcaacgtcctctcaatgtaactttgaaagaagatacccggttaatagacgaagtagtagttgttggttacggcgtacaaaagaaagcgaacctgacaggtgcggtgagcagtgtgaagatggatgatgttttaggtgaccgtccggtggtgtctgtgagtgacgctttgaaaggggcaatgcccggcttgcagattacaggtaattcaggaagacccggtgaagaaatgagtttcaacattcgtggtgtcaacagtctggataagaatgggaaaccgctggtgctggtggataacgtggagatggatattaatatgctcgatccgaacgatattgaatcggtgactgttttgaaggatgcggcatcttctgctatttacggagcacgggcagctttcggtgtgattttgattactacaaagaaaggctcggatgcaactaaactctctattaattattcaaataacttttcttttagcagacctgccaatatgcctcataaggctactccgctccaaacggtacaggcttataaggacatggggacaatcaattatcaaagtggtcagaacgtagatacctggttgggacttttgaaggaatataatgctaatccgtctgcatatccggatggttatgcaatggtggacgggctgcgttatagcttggcagaaactgatcttttcgatgatatgatggagactggtttccagcaaactcataatatctcggtaggtggcggtacgaaagatatttcttatcgtttctccttcggtatggtgaatgaaaatggggtactggcttcggataaagatacgtacaagcgttacaacgtgtcttcttatctccgctcggatgtgttttcatggattactccggaattggatattaaatatacgaactcgaactcttcattgccggaaacttccggaggatatggtatatggggagcagcagtcgcattcccttcttatttccctactggaacaatgaatattgacggcgaagaattaccgatcaatactcctcgtaacttgattgatctggcatatccgacaactattcaaaagaataatcttcgtattttcggaaaggttacgatcagtcctttgaagaatgtgaagttgattggtgagtatacattcaatcatctaagtaacgagaaaacgaaatttgagaagaagttctattatgcacatggaggtaactttgtgaaagaggtttccactgccaattccaagtatgaatattccaatggtattacggattataatgcattgaacttctatgctaactataacaactcatggggcaaacatgatgtaacggtgatgggaggtttcaatcaggagagtagtgattatcgttatgctgagatgtcgcgtatgaatatgattaatgaagatctgccgtctatttcgcagtcgacaggtgattattttgctaaagacaaatttgaacgttatacggtaagagggttattctatcgcattaactattcgtttgccggcaagtatttgcttgaaacgaacggacgttatgacggttcttccaaattcccgaagaatagccgtttcggtttcttcccttcggtttccgccggatggcgtatcagcgaggaagcgtttatgaaacctttgaactctgttctttcgaacttgaaattgcgtggttcttggggtaatattggaaatcagagcatcactccttacgcatatattcccggtatggatgcggaacaggcttattggactgtttccggtattaaagttactactttgaaaccagctgctttggttagcaatagctttacttgggaaaaagtaacgacaattgatgtcggattcgatcttgggctattggataacagattgaatatggtgttcgactggtatcgtagagatactaagggtatgcttgctccgggctctgaacttccgggtgtattaggtgcaagtgcccctttacagaacacggctgaccttcgttctaaaggttgggaaatctcggttgactggaacgatcagatcggaaaagtgaaatatagcataggctttaatctttacgatgcgaaaacaaagattactaaatacaacaacgaaacaggactgtttggcaaggacaagaacgataatgaaacatatcgcgtaggaatggaactgggtgaaatttgggggtatgtgaccgatcgtttgtacacagtggatgatttcgatgcagatggcaaactgaaaccgggtattgctaaagtggaaggttataatccgaatccgggagatatattatataaggacttggatggtaatgatattatcaacagtggtaccagtacaacgaaagatccgggagaccgtaaaatcattggtaataatacccggcgttatcagtatggtattcatggtagtgcaagttggaacggtttttctctgttattcttgctgcaaggagttggtaaacgagatttgtgggtgatgaacgatctgttttatccgcattatgatgcttggactaccgtttatgattcacagttgaattattggactccggaaaatacgaatagttatttcccccgtatttatgagaaagcggccggaaatacagatgccaatacacgtgtacaaactcgttatctacaggatggatcatatttaagtattcgtaatataacgctttcttataatttcccgtctaagtggatgagtaagattggagtcaataatttggctgtgttcttcagtggtgagaatctttatacgttcgaccacttgccgaagggacttgatccggaacgttctgtcacggatgatttaggacaacgtggttttacctatccgtatatgagacagtattcgttcggtataaacctttcattctgattgtttcacaacttaaagagtaattattatgaataaatatatactatgtgtaagcgttagtctttgtttgttgatgtcgtcttgtctgaatgacgaatttctggaggtttatcccaaaggacagcaaacagaagcatcggtctttactacctatgacaactttaaaacgtatacatggggattgtataacgtgttcttcggatatacgtatgatacagggcaaacggatgagattttccgtggtgattttgaatcggataacatgataaaaggattggatggatatgaaggccagtgggcatatcgcaaagcaaaggctacagatgagtctaaagattgggattatgattatatccgtcgtgtcaatctgatgctcgataatatcgatcattcggaaatgagtgagaccgagagggagcattggagaagtgtgggatatttcttccgttcttataaatactttcagatgctttccaaatttggtgatattccctgggtagagcatgctttgacagaggaaagtcccgagctttatggaaaacgtgatagtcgtgatttggtggcttccaatattctgtctaatttgaaatatgcggaaacacatattggcagtaatatcgaagcggatgggaaaaatacaattaatatgtatgtggtgaaagctcttatttcccgttttgctttatttgaaggaacttggagaaaatatcatggtttgtcgggggcagatacttatctggaagaatgtgcccgtgcttctgaagaggtgattaagcaatatccgaatgtgcatcctaaatatgatgagttgtttaattcggaaacactggatggggtggcaggtattcttctgtataaggcttatgaaaccggacagttaatgcatggtttgactcgtatggtgcgtacaggtgaatcttatattgaggcaacgaaagacgcggtagacagttatctttgtacggatggacgaccggttagcacgacaactagtcattatgggggtgataagaatatgtatggacaattccgtgatcgtgattaccggttgtatttgacgatctgtcctccatatatggtgaagaaagaaaacggacctagtacggctgattggaaatatacggataatgcacaggacagggaatttatggatttaatggctacgatttccggtgaaacttatcatcgtttgccgtcttccaactttaaaggattcactgtgcaaggacaacctcactttaagaatatgaactggggacagggctggaatgcttcccaaatgggcttctgggtatggaaatattataatacacatactgtagctaccaacgcgaatggggtgaatacaacagatgccccgctgttccgtataggtgaggtaatggtaaattatgccgaagcgatgtgcgaattgaataagctagaccaggctgctgcggataagtctattaacaaacttcgggcaagagctaatgtggcgaaaatggtggtgaatgatattaatgatgcttttgatccgaagcgtgatccttccgttcctgctctcttgtgggaagtgcgtagggagagacgagttgagttgatgggcgaaggtttccgtctggatgatttgcgcagatggaagaaaggagactatgttaacaaacaaccgctgggtgcttatgtgacaggggcttcggccaagaatctgaaagtaacgggtggtacaggtgctgatgaaggatatgtttatttctttgataccccgcttggatggcaggaacattattatctgtatccgttgcctttgaagcaattggctttaaatacgaatctggaacaaaatccggtatggacaaagtaattttaaattgaaatgatgcataagacctgtaatattttagtatattgcaggtcttgaaaatttaaggtagaaaatgaaaaatagaatatcaataaaatatgcgtttttttgtggaacagcttgctgtatctcatctatactacgtgcacaacaggatgcatcccaaatgaatgtcctttttataatggctgatgatatgcgtcccgaactggggtgttacggggtggatgtagtgaaaactcctaatatggaccgtttggcggcaagtggtgtcttgtttcagaatgcgtattgtaatattcctgtgagtggggcatcccgggctagtttattgacgggggtatatcctcattatcccgatcgctttattagtttttccgcctatgccagcaaagattgtcccgaagcaatacctatttcgggatggttcacccggaatggttatcatacaatttcggacggtaaggtgtttcatcatatcagcgatcatgcggattcgtggagcgagcctccttaccggaatcatccggatggatatgatgtatattgggcggaatataataaatgggaactttggatgaattcggaatcgggaaaaacgattaatccgaaaacgatgaggggacctttctgtgaatctgctgatgttcctgatactgcctatgatgatgggaaacttgcaaaccgggctattcgtgacttgaaaaggatgaaggaaaccggcaaaccttttttcttggcttgtggtttctggaaacctcatttgccgttcaatgctccaaagaaatattgggatttatataaacgggaggaaatacctttggctaccaatcgtttccggcctgaaggattaccggagcaggttcgtaattcgagcgagatatatgcgtatgcacgggttacggatacgagtgatattgacttccaacgggaggtaaaacatggatattatgcttgtttgagttatgtggatgcacagatcggcaaggtattggatgcattggatgaactgggattatcggataatacaattgtggttttgttgggggatcatggctggaatctgggagaacatgattttataggtaaacataatctgatggatacttctactcatgtaccgttgattgtccgtgtgccgggaatgaaaaagggaaaaacaaaatcgatggtggaatttgttgatttgtacccgactttatgtgaactttgtaaacttcctgttcccgctgaacagttaagcgggcaaagctttgccggggttttcaagaatttgaaagctaagacgaaaggtgaagtctatattcagtgggaaggaggagataatgctgttgaccggcgttatagttatgcggaatggatgaaaggcgacgtgaagaaagccagtatgttgtttgatcatcagattgataagaaggaaaacaagaatcgggtagatgagaaaaaatataagaataaggtcgaatcattatcttcttttatcagaataaagaagtcatcattaaagaaataatatgagaacagtttttttacagtccagccgtttggtatcggttgttttattcatgctttgcggtatgtcgatgtttgcccagcgacaggatatcttgctaaataatgattggaatttccggttttcgcatcaggtacaaaagggaacagaggtaagagttgatttgcctcatacttggaatgcgcaggatgctttgtccggtaagatagactataaacggggaattggcaattatgagaagaatttatttattcgttccgaatggaaaggaaaacgtctttttattcgtttcgaaggagtgaataacattgcggatgtgtttgtcaatcgtcgtcatataggtgagcatcgtgggggatatggggcttttatctttgagatcactggaaaggtggaatatggaaaagaaaattctatattggtacgagtgaataatggtgaacagttggatattatgcctttggtcggtgactttaatttttatggaggtatttatcgggatgtacatttactgattattgatgagacgtgtatttctcctttgaattatgcttctcccggagtacgtctgatacaggatagtgtgagccataagtatgctaaggtgcgtgctgttgttgatttatcaaacggaggtagtagtaatcgggaagtagagcttaatgtacgcctgttagatggtcaaagggtggtgaaagaaggaacaaagaaagtgaatctttctggaaacgcagcaatgcagcaggaatttacatttgaaatcgatcaacctcatttgtggaatggtcgccaggatcctttcctttatcaggcggaagtgattctttcccggaatggtcagatggtagatcgtgtcatacaaccgttgggacttcgtttttaccggattgaccctgataaaggttttttcttgaatggaaaacacttgcctcttcaaggcgtttgccgtcatcaggataggagtgaggtgggcaatgcgctgcgtccgcaacaccatgaggaagatgcggcattgatgttggagatgggagtgaatgctgttcgtctggcgcattatccgcaggctacttatttttatgatctgatggataagaatggtattattgtatgggctgaaataccttttgtggggcctggtggatataatgataagggttttgtggatttatctgctttccgtgccaacggaaaggaacagctcaaagaactgattcgtcaacattataatcatccttctatttgtgtatggggagtgtttaatgagttgacggagttgggagataatccggttgagtacatcaaagaattaaatgtgttggcacatcaggaagatcctacccggcctacgacctccgcaagtaatcaaatgggagatttgaatttcataacggatgctattgcttggaaccgttatgatggatggtatggtggcactcccgctgatttggggaaatggttggatcgaatgcataaggatcatccggaaatatgtatcgctatcagtgaatatggtgccggtgcaagtatttaccatcaacaagattcgttggttaaaactgtaccaaccagctggtggcatcctgaaaactggcagacgtattatcacattgaaaactggaaaacaatctcttctcgtccttatgtatgggggagctttgtatggaatatgtttgattttggtgctgcacatcgcactgaaggagaccgtcccggaattaatgataaaggtttggttaccttcgaccggaaagttcgtaaagatgctttctacttctataaggccaactggaatagggaagaaccaatgctttatttaacaggcaaacgtaacacagtacgtacacaacgtttgcaaacaattactgctttcacgaatctgtcaggagccgaattgtttgtaaacggtaagagttatggcaaagcaataccggattcgtatgctattctggaatggaaaaatgtggaactagaacctggtgaaaatgaaataaaggttgtttccactaataagaagttacctttgagcgatagttttcattgtagattgtgataggtagtttaaatgataatcggaaagagcactgtaaacaaagtaggtttgcagtgctttttttctaggggtttctcttttgggagataataatccttcctgaatctataacagcggataatgatactccaacagtataacagatcatatctgaccatagaaaaccatgtccaaagattaatgctccaagtgtggtgtttcgtacagtatttgcccagtctgcttggtatagttggctaatttctatacaataagaaaataataaggaaataacaatggtcttgagtatagataatgatgggaaaagaaagcgtattccacaatataccatggctgcccaaagcgtatcgcctgaatactctgcgataaattcgggcaatatatcaccatgttttcgggaagccaatcctaacactataattgcaaaagtaattgctaaataaatccaacgtttgtttttcacgcagtaatgttttagtatggtgcaaatttataaaattaagttggataacttggcaggatggatcaaactctgataaaaacagattttatttacatactaaacctttcgttcttttgaaatgttataaggtcgttcgagttttatctcgataaatgtgttcataaccaaccgatttacgcaattgttgtggaaacggctgcagttggtcacttaaaaagttagtaattaaaataatagagttatgaagaatctttttcgaccgttgttagtactgacaggatgtatagtattggcgagttgtgtaagtcagaagcaatttaaaggtttaaaaactgattatacaaagttgcaaacagaatatcaggaaagtcaattgcagctaagagaaaatcaggcacgttcaacaagtcttgaggagaggcttgccgaagcgcagcggaataatagtgagttacggaagagcttgtctgatatgcaaagcatcttgaataagagtcttacacagagctctcaagggaatatgaatatgggtaagttgatagatgagatcaatgcttcaaaccgtttcatccagcatttggttaaagaaaagaatagatcagactctttgaatctcgtaatggtcaataaacttacccgttcgcttacccgtgaagagatgcgtgacttggatattaaggtattgaaaggtgttgtatatatttccttagcagataacatgctttataaatcaggaagttatgaaattagcaataaagcagaggctgtgcttagtaaaatagccaaaatcattcaggactacaaagattatgatgttctggtagaaggaaatacagataccgatccgatatctcgtacgaatatacgtaataattgggatttgagtgcgttgcgtgcttcatctgttgttcaggcattacagaatatttatggtataaatcccaaacgcctgactgctgccggtcgaggtgaatttaatccggtagccggtaatgatacggcagaaggaaaagctcgtaaccgccggaccgagattattataactcctaaactggatcagtttatggatttgatagatcaggctcctgataattcttcatcaggtatagtgggggatgagaatacaaaagagtaaaggaaatatttccatctagggccaataataaagcgatgaatttgaattcatcgctttattattggcaatttgaaacagatacagtaaagtgttagaggtatctatattttattttcagagcttgagaaattgctctattttatagagagtccgatttgaaatgagtattgctgattttaaatgttttcggcagatggacctattttgaaaattcaaactcatatggataaggagtttgattccatgaaacccattctatctttccataattatgcaaatcacatgggaaaaccacagaatagtcccatggattatatcgatatggtatgtcaacatattgacaagcatatttatttgaatatagccaatgatatcctgttttagagtcgctatatattgctaccataaaatatttaccaatctttactttagcggaagtatatgttgcttttattgacgaggcaaatatagaataagtagcatcaactatgctaccatctttctttttaatttttgattttgacagcaaattccaagtttcatcttgtattttttgataatcaagtatattccctgaaaaagtttgctttttcacatcaaattcctcattgttgtcagccttaaataataaaaatgtggtggaaatattttcgtaatcagactctggagtaagagctttgtatccatttagccaaatttcctgaatgtcacttttttcttcatcacttttactacatccaactactatcagtgcagtcataattaaaaatagaagttttttcatgtctaatttattgattatagtacaaaggaacatacaaaaccacgtattagcaaattttacgccaacaaattgagcttagaactgtattttcaggaattattcctttttcattttcagaaccttctccgaattatcaaaggaatatttcatatatactttataatttaatgcaccaagttaaaatgaattttatgtgaaaaagaatctctcccttctttttttgagtggctattttacattaatcagcagtatacttatgtcataagatagttctgttttgatgtaagaacgatcttttttgtgaaatacagattagaatggggagtctatgcagattgttttttttaattcagaaatgaacttttttagaaaagcaaaacgctaattatctgttgataatcagcgttttatttaagtgattcaagtaacgttctttaatcgcctgattattaattgtttgtataaacgtatggcctacaatatgcctacatttcttatctattacaggttatttcttacttaataagacttgtattagacgttccttctcctcaattatcctttctaaatcagctatttttgcatctttatcaagttcatttgattttattccagttatgggaatatcatcaaagaatacacctacaggaacctctaaaacctttgctattgcctcaatggtttttgtgttcgttgatccatttctaacaatagcctgtatgctactatcttcttttcctatacgtgaagcaagttctcgtatagtgattttctttaattcacataactctcttattaacaaaaaattagccatattacacctttgttataacttttattaacgtgaattttattcacctgtggtaaaaataattatacctttgctatgtaaagttaacaataatgagtatatttatcacaaaggtatgacgaaaaaaaaattaaaaaggaatgatgacggcgagaaactaagaatgtaccttttgaatttgccggtaaaagaatcttctgaaatgtcccttaaattggcagaagcatgtaaagtgccattacatacctttcgtaattggcgaggtagtcgttgtcgtattcccgaacttgcaaaggataagatcgaggaagtaacaggcgtaaaaatcttccatagtgaaaaccaataaataaaagaagaatgaaatcaaagaaattagaaatcgaaattccggaaggtaaaacagctgtctggagaaatggaatcttaacccttattgatgaaccagaaaaagacgtaagaaaacgtattaagacgtttgaggacgcctgccatgaaattggcatcgatgcagaagcatggaaccgagataaaatatccctcggtcttgaacctgacgttttggcttttctgaaactccgtatcattgtcaaagctttaaatgaaggctgggaacctcgatttacagaggatgaatgccgttattatccttggtttattctttatacaggggaagaatacaataagttggacgaggaagaaaagtctcgtgtggtgtgtcggtcgaacaactacgcgttcgcgttgggcggtgtttcgtatgcgggcgcgaatttcgattcatcgtacacgtttgcgaacatcggcgttcggcttgccttcaaaacgtcggaactggcagcatattgcggtcgacaattccttgatatttgggcagactttgtttttcttccggaaaagaaaagtgaataaataaccggggcggcttttgccgctccatataataaccgccggagtgtggagataaccccgaagggcgaaagcgggtgttattggtagttcgatgctatcctccggcacagctataaacaacaatgagcaaaatttacatagtaactaaaagggaatccggaatatacgaagaagacggcgtttggttttctatccttgccgcatttgatacgagaaataaagcagaagaatatttaaaggaatatgaaaaaacagctcctaaagaagcttactacactttctatcgaatagaacctgttccgttgtttctttcttctcataaagtgaaaataaacagaccgaaacatacgacctatcctattggtgaattggtaaaattaaaaataagtggtgaaaaataattcaaatcaagaaaagataatgagcaaagaagaagctatacaagcaatgaaagagggtaagaaggttacgcaccgtttcttttcctctgacgaatggatgactattgaaaacggatttcttcttttagaagatggtgtacgtatctctttggaagatttcttcaattttcgcagtgatagtctttgggataatggatatgaattgtataacccctcataacatgatagatatgaatacaacctttgaaaaatcggctaataccactgatgagtggtatacacccaaagaaattatagacgcattaggaaagtttgatttagatccatgtgctccggttaaaccgctttggcaaacggcagaaaccatgtacaacaaaaaccatgacggattaactaaagattgggtaggtcgtgtctggttaaatccaccttattcccgtccgcttattgaacaatttgttcgtaaactggcacaacacggcaatggcattgcgctgttgttcaaccgctgtgatagtaagatgttccaggatattatatttgagaaggcaacggcaattaaatttctacgcggaaggattcgttttttcaggccggacggaatacggggggattcgcctggttgtggtgctgttttgatcgcttttggagaagaaaacgcagagatactaaaaaacttgtaacataagtggcaagtatgtaagaatcaattagagtaaaacaaattaaatatgagtgaatattcattgaaagaaagagttcagatgttaacatcatcgcttgtatatggcggtcctatgacatttgagcaaatcaagaaattagattggttgaaaaatacatctgaatacggaatattattttatctccgggaagctgaaagatatgaatggataaagactaaatgtttcaaaggtgataaaccgaatatctattcggcaacggctaaaggccgaaaaatggctgatgcaagagattaaataaaaatggataagaaaaataaaagggtgtatctttctaatacaaaagaagaaagagcgataaatataaatcagttttttacactttatgtggacttttctaaaaataatacagcaatgaaatcaacaattaccacccccgatgaattaaccacgttacgaatagaaggcagtagtggaacctataaaatattcagtagcttccgccccatggaatcccctgcattcgtggatgcaatggaccggaagtataatctggcggaaataaagaatctttccgacggaaaaggttatttcctggtacacctgaacaagaagcaacaggaaaccatacaggaggatttaaacgctatcctttgtgatagtgtgccatgccttctataaactaagacgatcttaacgaaatgccatgaaagaagacagacgcctaagaaacctacgttatcagatgcggaagaaaggttaccagttcgatacaaagaacctggtggtcattatgccttcacatgacaaacgttcccttctccaggaaaggagattaagcaaattcggtttttcaattcagtataacatgtttgaacaatgaaagataaaaatttaaaatacatcgcccacgctattatcgtggttgcctttatgggactgattgcctttgtcatttattatacgggtaaaaccgcttttctttggctgttattattcgttttcctgtatcaaccttggggagacttgaaaacaaagcaggaggaaaacaacgaaaaataagtaactatgtaactttataacgatgataaaggcagaagacatctacaaagtaaccaacaacgggctggatattattctacattattatccgcaagcccgggattgtgtcggaaccaaccgccatttcaaacgccggccgtcagaagacgacgcgtcggcctgtatcaagctattcggaaaggaaggttcccagcaggtttataaggtaacggatttcggtgataccggaacggctcaaagccctgtcgatatctgcatgtatgaggaaggcctccggtttaacgaggcgatccttaaacttgcatccatgtacaacgtaaccgatgaactcaaccgtaacgtaaacaagccggatatccgtaaggttccggcctcccaggatcagaaagacggtactaaaattttcgagcttgccgatcatctcaccccggatcagttacgcatactcggcccccgtgtcacccaggagaacgccgaggctctgcactggtattcggccaaatatatagggtatgtaaaaaatcgcgaggtaacctataaatacgcgactgcgacataccctatctttatgcgcgaatgtctggtaaaaccggccgaaggcgacacgcccgaagtgaagttctataaaatatacgagcctctgaatccggacaagcagtggcgtttttcctacaccccggaaggtgtcaagccgaaggactatataaacggtctttccgaactgaaagccttatactgggagtttaattccagggaagaagccgcctttaaaaagaatccggccaatgcggaaaagccttataaggaacagaagctgcaggaggcgtttatatgttccggagagcgcgacgccctgtgcgttaaatcgctgggcttttccccaatctggtttaattcggaaacatataaactttccgaacaggactacaaggagatcatgaaatacgttgaagtcctgtataacatacccgatatcgacacgacgggcagggtaaagggtacggaacttgcactacgttttatcgatatccacacgatctggctaccggcctggcttaccacttaccgggatcagcggggcaaaccccgtaaggacttccgggactttatggaattacgaagcaagaacgaggatttccgtaaccttatgacgcttgccatgcccgccaaattctggtattccaagtttaacgagaaatcccggcaatgggatcacaatatagacgcggactgccttcactactttttacgtcttaacggtttctattcgcttcatgatgaaaattccagttcaacgaaatacatccgtattaccggcaatattgtaaaactgataaaggcaaaggatatccggaagtttatccgcggttgggcccaggatagttttttatcccgcgatataagaaaccttattctgaacagccccaaactgtcagatacggccctggacaatttgcaggaaatagaactggactttaccaattatacccataatacgcagatgttcttctttcccggttgcagcatggaggtaagcggtaccggtataaaggaacatccggccaacggcagcacattgtcccactacgtttgggaagaaaacgtactgaaacacaaagttcgtcttatggaagacatgtttaccatttcccgtaaaaaagacatagaggggaacgatgtttttgatatccggatcaatgccgtcccgtctaactttttcggctatgtaatcaattcgagccgcgtttactggcgtaaggaactggaatataatttcgacgacaagagcgtgggggaagcggaatcctaccgggaaaaacataaattcgatatcgagggggaaggcctcacggcggaagaagtggccgaacagaaaaggaaccttatcaacaagatctttactatcggctatatgttgcaccgttataaatccccttcgcgtgcctgggcaccacaggccatggataacaagatcggtgaagacggtgaatgtaacggacgttcgggcaaatcgttcatgttcaaggccctttcctactttatgaagaccgtcaagctttccggccgtaatcccaagttaatggataacccgcatgtgttcgaccaggtaaaccagcataccgactttatcctggtggatgattgcgaccggtatcttaatacgggcctgttttacgatatcatcacatcagatatgaccgtgaacccgaagaacaaccagtcgtttactatacctttcgaggaatcggccaagctgggatttacaactaattacgttcctattgattttgatccgtctacggaagcccgtttgctgtacctggtattctccgactactaccaccagcgtacggaagataacgactaccgggaaacgcgttctatccgggacgatttcggtaaggatttgttttccaagacttacagcgagaacgagtggaacgccgatataaatttcttcttgcagtgctgccgtttttacctttccctttgcgaggaatctataaaattgcttccgcccatggaaaacattatcaggcgtaaatacaaggccgatatgggcaataactttgaggactgggcgaactcttatttctctccggacagcgagcacctggacagctttatcgtccgtgaaaaggcttttgctgattacaaaagtttttccggtgtgaataaaatcacgatgcagcgttttacaaaggccctcaaaggctttgtggccctttgcccttacattgacgagctcaacccgaaggacctttgcaactcccaggggcgtattgtacgtaaggataacgacggcaaggccgccgacatgatctatctgcgttcatgcggcacggcggaaacggctgccggtggtggaacggaaccggccgatccgacactcatgtttgtacctgatgaacgaccggatgaatgaataacgcgcatttgaaattaaacagcatgtccgagtttaccgcgctctggaacagcggcgagaggttccggaaattcgccgaacaggtctaccgctatctggagcgtatgaaacccggtaccgtcctggcactggaacgctattcgggcgagcagctcgaatggatcatcaaaacggcctgtgtttttatcctggaaggcgacaactacctggagtatgaatttaacgaggactatacggccgtcgtgcaccgctatatacccccggacgtaaagaaatggattttaagcaggtgcaaacatcgcgtataagacggatcggagccggtataaaatacgaaaagagggaccagatacgaatgtgtcggtccctcttttcgtatggaaacaaatgcgtcccgcccggcttccctccccataccccacctctatttcatacaaaattttagtaaccttgtaacctttgtttgcttgaaagaaaaaagtctgaaaatcaaataaataaataggaaataaaggttacgaagttgcagttacaaaacggttacgaatttttccggtttgtaacaccggcctttttatcttctaccggtaagcccggttacaaactgttttccggccatttttttgtaacggaaattagtaacgttactaagttgctaagatacaggattttacctttgtcggttgcccggttacgaaattacaaaaatttagtaccgaattatattagcacagcctggcagagaaaatgtcgggtgtgtggcggctggaaaaggcatattataattattctcccggagtatatttatcaaaatgacgactgaaagcctacattttcccgtaaatggcagaccaacagccgataaaggaatatctttgcctttaaaaaggaatgttattgctatgattaccacccgaatacagatcgaatcctacctggccgagtatatccggggcaaatattacgacgaaacggtcggtaccgtccgttttccttcctcgtccgatatctatgtgaccgtttacgatctcatggagaaacggccggtaaattgtccggctgaccgcggcaacctggagtttatgctgcctgaccgccgggaggccaattttgccggcggcaagtctccggaacagttcaattacatttccgtacgcggtaccgccattcttgaaaagcgtctgcgtgccctgatgtgggccgagctgcacgaactcatggacgaaaacaagcacctgcacggaatcgagtttaaggaaaccgtttttaccttcctgaaaaagtatgatatctcttccattcaggaagacgggctgctgaaaaactaccagcggtggcgggacagtttcaggcgtaagaagaaaagggcgtataaccgaaaaaaagtgtaaaaaagcaagttattttttacctaccaactgtatctgtttgtccttttttgtccggtttttggctgaaaaacgtccgaaaaatgctgaatgtttgattatcaatgctttatatctgtaattatgtcaagaaagttaatatccgccgcccatagcctgcaactggttcccgtttacaacattatccattttggcgtcgtgctctcgaaagtcgttatccgctctatcggaaaacctgatattcttatgatcgtaccgggaaccttaaaaccgggtgacagcaaaaatgaagacgtctatactaaaaaacataccttcaagcttgccgacgtgtcgcaaaataagacgctttacctggaaaacctgaaagcgacgccctttgtcgccctctatactgacgaaacgggtaacacccgtgtttccggttctcccgattacccgcttaccttttcttttgagatcggcgggggcctgtataactgcaccctgtccggtacgggtccgggcgttgatgcgttcctgtaggttcctttcagtccttctctacctattatataggcgttttctttgccgtaaaaaagagaacgtggacaaaatacaggagatttttacagcaccttgggcaatcgctgataatgattattaccggttgctttccttacttgtgccgtgtgttgcagccggcaacctggatgcgatcgaaaaacggctcgacaataataaaataaccgcctacgctactacgccttaccttgccaaccggtgggaactggacgatgagacattgccggctgacagtgtggccgtcattatcctggaaggcaccttgtattcctgggagacttaccgcctggaaaagcagctccgggatgttttcgataatcctaagatttgcggtgcggtactctggatcaatgggccgggcggtatggtcgcacatgtggacctggcggctaaaatgattgccgaatcttccaagcctatagctacctatgtggccggtaccatggggagtgcccatttctggctgggaaccgccgccggtagaacctttatcgcttcccctatgtgtgaagtcggttccgtcgggatcatgcttacttaccaatcttttaaggaatattttaggaaacagggcattgattaccgggaaatctatccggatagtgccgatctgaaaaactatgaaacccgcgcgattgaaaaagagaacaacgaagagcctataaaacaacgtctggcagtcatgcaccgtattttctgtgatgcgatcagtcggaatctgggtattgcctacgatccggaacttccccttttccggggacagatattcaccggcgacgtagccgtggcaaacggttatatagaccagttcggcacgctggaagacgctgtaaagtgggtactggcacaggccaccgtcagaaaagtaaatgagatgtataacatatagtattaacttcaaaattttgtatatatgaaatttaagagcttttccgctcacattctggccctgctgggtctgtcggaatggagcaaggtagaggacaaaaactctatcacggtcgaggaagtggcaaaactgaaaaattacggttttaccgaaaaattcctcacggactttaaagcgtccctcgaaaacgatttccaggacgaatccgaagacgggaaccagggagaggaaaccgaggaacctaaaactaccgctttccttcgtggtttgttgggtgacactgcggcacgtctgacacaagcgcaggaacagcttgaagccttgcagacgcaacagcgtgacgagaaccggaacaacaccgcgttaattgccaagaaggatgccgaaataacaaagctttccggtattatcgctcaactttcggccgctgcggaagatgatccgggcaaagggaaacaacacaacgcccaggcggacggtaaagggaaattcaatctccaggacgaaaagcagctggggggcttgcagggtgaaatgttctcactggaggaccgcccgtataaccttcgcgctaaagctgcgttaatggaggctgccggttttgaaatgatcgctcttccgaaagcaagttccattgactacagccgtttgaaggaggacctcggggccttttaccgtattccctggcagcagcgtttgcagtcgtttttaatggaacttccttccattgaaagtattttcccgcttgaatccggttatcaggatttggctacgctggttaatatctggctgggtgagttttcacaggccggtaatgaggaatccgacttcgataaggtgactaaaggttcctacgagttcgacgatgaaaccctgcgcatgttcaacgtgatgtttgcacaccgtttcaaaaatttaaaggccctggagaaaacttggatcggcactttgaacaaggaaggttcaaaccctatcaagtggtcttttatcgagtatatcctggccgaaaccgccaaaaagttgcataacgagcgtgaacaacgccgtattaacggaatccgtaaggacccgaatctgaacgaacccggcaaagcacttgctgcagctgacggactgtatgagttcctgaacaagaaagtgaacggacataccgatatcaataacggaaaactcgtttaccagatcaagccgttcgaattgggggaaattaccgaagcaaacatcggtgaaaaagtgtacaagggtacttccatgatcccggcggttcttcgtgacagcggtaacctggcactttatatgccttcgcactttattgtattgtatcataaatacaatgaattgcattacgggcagaaccaggattacaaggctaacatcatgtatgtgaaggaatatccggcggtgaagattattccggttcccaatgctgacaaccaccaccgtatcttctggacgtttgaaggtaacattaaaacctacgaggataagccgggtgaaatgacggctttcaacctggagcaggaagactggagcctgaaagtctggagtaactggcgtgaaagtatctgggctattgccgtgggattcaagtacaccaagaaagaagatatggactatacgcgccagatgatcttctgtaatgagtatgaccgcccggcgtcttacttcgtggatgctgacaaggacaagaacccgtcggccaaacttcatacatccattgttaccgtagccaatacggccgaatttacgattaccgatattgaagacgctccggtaggtgcggttatttccctgaaatgcggaagcgtggataagggtgttaagatcgagaaaagcggaaattttgaacttatttccgatgcctggcagcccggtaagggggacgttatcaaactgatgaaacgtgccgacggtaaatttatcgagattggtcgcgaaaacgcttcttccgatgcgttgcagtttgcgccggatgaaacgacaccttccttgcttgacggtgaagtattcgttaccggtgtaaatacaaaagcaacggcaatcactaactttaccgatgcagaagccggaatcgtttacacgatttacggaaacggttctgaaaatgcttctaccattgccagcggtggaaactttgttttaaccgaagctataacgctttccgaaggcaagttcatcaaattggcgaaagctgctgacggtaaattctacgaagtggcaagaggctaaattaatcggaaggggtactttatcccttccattttataaccttataaatcattaagttatgacatacgtaaaagcaagcgtaagaaggccggccggcaatcccggtaatggtattcagcccaaggatcagctcgtaatttacgacgttgacgatattctttattttccgccaagaaacgaggccggcgtggttatcgaggaggatatcgtgatgaaggcggggcgttatgcgatcggtatttacctgacacccggtaccgctgaaatcagttccaacagtgacggggaaaccgacgccgaaggttatacgccttccgttaagttcaatcatcccggtaacgaacaggagattcgcgagtttaagacaaactggctgtctaaaaaatgtatcgttgttctccgttattgtagcggaaagcctgccgatctgatcggaacgccctgtaacccgtctaagttatccgtttcttataccggttccaatgaatcgaatacgaacgaacttactttcacccagatcagcaagggggatgatatcgccatttaccggggtaccgacaccctggaagaaccggtggccgtagtggaagccggtgccacagatatagattaccagacagacgggcagtaccagctttccgcaggtgcggccaaaatagccggtgttaccggtggaagtcatggatcggtaattacccttatgggatgttcgggcgttgcgccaacagtggaaaaaggcggtaatttccttctgaaaggcggtaagacgtttaccgcttccgaaggttcccaactgacattgcgggcgtttaacgacggttcggaggctatgaaatggattgaacaaagccgttatgaggcgtaagtaaacggctttcatatcattcaaagggtgaccggcagcacatgcccggccaccctttgtcctttttgggggtaattgccttttttttctttgtatcatcaaattttatatagtatgaaacaggaaattattacctatctggccggtccgcgtaactttattcaaggcgtggaactgtacgagaaatacggtatcaaccgtatgctaaagaagtcatttcgccggcagggagaaacggaaacgatgaaggccattcttttagaggaactacggaagctggccgggctttccgaacgtgaatttaagacgatccggcgcaactctaaacagccggccgcggtaaaaatggaacccgcccgacaggaacctccaaaaatgccggtaaaatacagcgatgatttgctgctggaacttgccgaatctttcggcgtcagcgtggaagaactcgtttcgtccgatttccgggataaggttctttccatggatgaaaatgccgaccgtgtggaagagctggaagaggaactggaagaggcggagaaacgatacaaggcggctccggaaaccgtaaccaaaatgatacgtttccgcgagaaatttaccttcctgaactctccggattgtcccgacattctgaaaatacttgtttccgacatgttcaccgcatacgggaagtataaggaggctttcgcccgtctggaggttacgccggatgatgtcagttcactttctacagcacaggaagcgcaggcggttgtggaaaatttcattactaaccgcgaaatgtgggacgaactggaatattaccgggaaaacggaaagattttgggtaaatgtgagaaggtaaaaagtttgtccgtccgtaagggtgtcgagaatctttcggatatcgacatacaaaaggcattgaataacgctcgtgccaacctttcaaagaataaggcgaaactggaacaggccggggatgatgagaagaagaaagcgagtgcccttgcaatgatccaaaagtgggagactacaaagaaagccatagaggaagaaatcgaggcgcgaaaaaaaaagtagttgaacttattgccactttgacaggaaaacggcaacggatcatgaaggaccggggccgtttttctcacccttgcgaccgctcggagctggggcaccagctcaagacattaaccctccggatagaaaaagaagaaagccggcttaaacaactttccaatgataacaaaccaaatttataacgaggattgcctggaggcgttgaaacgtgttccggacaattctgtagattgtataataaccgatccgccttatttcctgggaatgacacataacgggcagaaaggcagttttaaagatttgtctatctgtaaacccttttaccgggatttgtttcaggagtttaaccgggtgaagaaacccggtgcttgcgtgtatttttttacggactggcgcggatatgctttttattatccgttgtttgacttgtatttaggcgcgtcaaacatgctcgtttggaataaacagtcggggccgggtaatcattacgcctttatacatgaacttattttgtttcattgtggaaagggtgtttctattggtgccacaaacataatagataatatccgttcttttgcgtccggtgctaaactggtagaaggtgaaaaggttcatcccacgcaaaaaccggtggcgttgatccgtaaactgattgaagacagtacaaagccgggcgatttgatcctggacactttcggcggttccggtactacggccgtggcatccattgaaagcggccggaactttgttttaatggaacaggacgaaatttattatttcacggcacagaaacgaataaaagatgcgtatgaacgatttaacggtggtagatagtatttacctggatgcgcagcaaaaagaggatgtacggcgtttgtcttctttagggtattcttcgaaagacatagccgtttccctggggctttctccggaagatgtcgggctttttgtccgggatgcggaaacggtgggaacttctgttaactttctgatccgggaagggattctcgtagcacgtgccgcccctgaaataaaactccatgaagcggcggaaggtggaaacgtggaagctataaaacagctggaggccgtacggaaaagacatacttttgaacgtttaatcgaacaaatggatgacgacgaatttaattaagccctcacgaatagactttgacaaggtggatatcaaccagattcaaaggattctttctaccggtacgctggaagcactcgcgcccgatgaaagggaatattacagccttatggaaatggtacggggccttcgtgcccgtatgcgtataaatggcaagttggtgacaaaggccggtatcatccgccttttaaagtcggagccttacggcctttcggactggatggcccgccaggtgtacgccgacagtctcaatttcttttatacacaggataacgtacgtccgcaggctttcgccaacctgtatgcggaaaaggccgaaaattgggcgaataccgtctttcttatgggtaatgtaaaggaggctaagaaccttctgaaactggcggcggaacttcgcggatgttataaggaccaacagaccgaaataccggaggaactgctttcacagaaaagcacggttatttatactaccagccgtaaggatctgggtgttcctgaaatcgaccgtaaggaattggaagagtttatcgacgcgataccggaaattcctgttattgtacgtgataatataaaagaggatgcgcgtattaaagcttttgatctgaaaaaacgtatgttgtatgatatcaaagagttcggggaagataacgaaggtgagtaacgccgatgatgtagaaataaaatacggtcatataatccaggttctgacggactggatcgatactactatccttgtatctattgacggccgcggtatggctaaatctaccgttatacaagccaggcgttccgcccggtgtgtggaagaaatgcccggcggtgcgttcgcttttgttgccaatacctacagtaacctggaagataatataatgccggccgtacagaagggctggcaacttatgggcctgatcgaaggggtacactatgtaaaagatacccgcccgcctgaatcctggcggcgtaaatgttcggttatcgtagatgattacaagcatgtttatagcttctggaacggatgtgttattttcatgggatcactggataacccttcattgcttgccggaaagtctgtaatacatctgttttatgatgaagcgaagtacgataaggaaatgaaagtaaaccgcgctatgcctattcttcgcggtgatgcgatcacttacggacattcccatttgttcctgggaataaccattactaccgatatgccggatatcgacgaaaacgagtacgactggtttttccggtatgtcaagcaaatggacccggaacggatcattaaaatagtgcaggcggcaagtgtacgtaatgacttgataatttcccttttacgggaacaaagaaagaacaggccttcccccttgaaactgaaacgtttgaagcgggatattgaatattacgatcgggctttgttgaagttgagaaaagggcagacgttctttcttaacgcttcttcattcgctaatgttgagatacttacgatagagtatttaaagcggttgtataatggtacgctggagcttcacgaatttaaaaagtcggtggtgggtatgcgtcccggtcttcgcagggatttacgtttctatgtgttgtttggtgaaggacataagtattataacggtaccatgtctggagaagccgcttacagctcgcgggaactccggtacctgcaccatgataaagcgattgaaggcggtatggacttcggtaatatgctttctttggtgatcggtcagccggacggtgcttattaccgggtacataagaacttttttgagataccgccgggctggttccgggagatcgccgaccagttcctttcttttttccagaaccacgaatacaaagaactggatttgtactatgaccgtgcaggtaataactttgaaaaacagaaggaggattacgcgggtaagatcaaagacgccatagaaaaagacggcagcggaaaccgtaccggctggatcgtaaacctaaagagccgcaaacaggcagttatccggcaggatgcggaatacgacttcatgcaggagattatgggcggtaccaacaagaacctgcctatcctgttggttgatgcggtgaactgtaaagaaatggttagttctgtagaaaaggcaaaggctgaaatcaaataccggggtaattctaaagtagtgttcaaagtgaagaagtccgaaaagctggcaccaaaaaaactaccgatgttatccaccaatttctccgacgctttcaaatacttactgatgcgccccggctggatagctttagtacgaggcaagcggacgctgcaggccgactcgtttgtggatcaatggatagagaacaggcataaaaggtaattgccttgtaacgctggaaaattggttttccggcgttttttgtgttaccaggttacgggtacccctccgggagaggtcatatttcaccttttagggggagggcaactgctttccgacttctgagcggctcggtcttcggaaggtgtcatttttttagtttttgaattttttttcggcttttgactgtttttcagtcgtttatctgcatttagaccaaaattttacgcgaaaaagtgcgttttttatgtgtttttgtttcattttttgcccatttttgggtgaattaccgtgtattttggggcggttgcctttcatttttgattgattttggggtaatattttttataaatgtatatatttaagtacttttgcaatcgtcaaaattacactgcatatataccgtcaggacttacggggtggtacaaactaaagtacacactaattttaagttactgatatgaaaagattttttttagttattgtattggccatactaacaatggcagccattgcacaagaaccgtataaggcttattgtgaaatcgtgggtactggaaatataaccggtacaaaagtaaaaatagaagtagatttcggccagaaggcaaaatgggcaacaccaaatgctcgttttttagtagatgaaaacggtgaaaagatgaattttaattcaatgatagacgccgttaactatttggctaaattgggttgggaactaatactggcttatccggttacacctacacaaggaatgagcaaagaccctgtttatcactatattctttgtaaaaaggtaacttctgatgaacagataaaagagggaattaatttaaaagacaaatagaatattaattatagtgtgtaacgctcacccttaatcaggtgggcgttttttgttacgaagtaacgaatcgtagagtcgagaaactttctttcctaataaacttttattaacgtttttttttttttgttcagaatttaatgccgacatttgcccctgtcaaagttaacaccgctggtgcggtccggtgagtctcggttattggctcgaataaataacgggctttttttatgcccgataagtgcttgtttaatacaaggcggttgcctttccctaaacttataacccgatcttcggacggtttgcggtgttaattttgacgaattaggggaaatggtaaccgcctttcccatgtaaaatagtcaaaattaacaccgttatgaaaaatgaatttcaatccggtacaagctatgtaccttcgttccgtactggtagcacggacgtaaacacaatccaacatcgttattttcaggaaccgaaacatgaatgtactgtttgttcaacttctggggcttattacttatctgctatcgcttgtttctgtcttacttttatctatccaccggctgtcattggtgcagttatatgtgtgtgtcgtgccaagaaagcgaggaaaggaggccgaaaatgatatcttattttatagagcttaacgaatataagccacagaaccgaaaatgtgctgaaatggcagagtttgcaaaccagtttggtaatacgctttgccctgataaaatttcctttgatgcttttaaaactgaactggaagcaaaggtaaaggagctgaacgagaaataccctaaaacaatgccgctgaaaatatcttccggtagcgggtttattcatatagatcaggacactaaaacacataataacggctgtgacaagcctgtagcctattttttcatttaccgggttaaaagaatatataggttttcagagcgtccccagatagaaaagaaaggaggtgccgaatgatatatactgaatatcagcaagtgttacttactcaattacaaaacaatgataaaaggattgaggaaataaagaaggaaaaggaagaaatacaggaaatgtttctacaagaaagtaaatttaaaccgggtgatctgatacagattgattataaaataagcaatgctacttttaaagttcgtggctggattttccggattacattctggaggaatcgcccgtattatcacctgaatttacccaagaaagacggttcccgcggattaagggttaaaagtgtatgcgacggggtactggaaagtataacaagtatttcacatattaaattagaagacttaaaaggaggtgccaaatgaatacaaataatcctgatatcctatttttcgttagacgtgaatacggcacgccttccattgaattaagagcctataaggtggagaaggttaacaatgagtttgctttccttgaacttgaacgtttgcggttggttgttttctccggtgattttcagtctgtatcacttcatcacgagtacggtaaaaacaactgtctgtataatagtgccaataatataccggatctgatgaaagacatgaagaggtggcagttatcgcccattgacagacgtaattacgaacggtttaggaaagtcgccctcgggatataccggcaggccggaataattgatttcactaccttagagactacaccgattaaaaacgtttaatgaaagatttgttatgaaagatatagaagtaaacggcgcacatataacagatgaaagtgccgagattttgacacagtggcaaactaagacggaaccggtttccgcttgttacatcgaagttattgaggacctaatcgatttcctaatagagaaaggagatgaaagtacaccaacaaatgaggtgttaagaaggattcaattattacgtatgatgaaaaaagacatcgaaaagttgtctaatccttaatattaacaatttagcataccggctgaaaaggcagccgttgggtttaagtcccaggttagggtttgtttgtgccggggtggttcccggcactcttttttatgtccttttcgtccgtttccgttcttcccacctttgcagtaaccaatgattcaaattatgaaaataggaacggacaaatggaagcatttcggaattaattacgctatatgtgccctgttgggtgattatggtgttccctttgccctgggtgcttcactgggtaaggaatacggggatgaaatgtccccctgtaataaatgggactggaaggatattctggcagacctggccgggatcgtggcgggttatttgacgcatgtatgtatcgtccggactataatgtaacattttcaactctactaatatgacggaaacgataattacagcgattattacagctctttgcacgggtggcctgacttggttattcactctccggtatacccgtaaacaggcggaagctgacgccatgaagtcagtacaggaggtttaccaggaactgattgaggatatgaagaatgaccgtaaggaattgaaacagcggatcgacgatgtagagagccagtaccgggaactccagcagaaatgtaacgaaatggaaaaggatatcaggcagaacgcccgcgtaatggatatcatgaaaccgtttctttgcggggtgaaaaattgcctgaaccgtaaatctatcactttcgacactaataactaaaatcaattatgagacatggaatcgtacacctacttattcttatttgttttgcagcttgtttttacggttgtcgttctcctcgctctgttacacgaaaaacggttacagaagcaactggagaagaaaaacaaacaactactgacggagttattgaacttgcgcggagagattcgagccatgaggagcacgtacttgacgtttaccgggaagatagtacgcatatccgtatcgactacgacagcctcggaagaattaaagaaattgatttcagtaaccgaaaaactgaaaaaagaactggaaagaatcaaagcagttccctccgggatcataaggaaactaccagtcaaacggaaacagccgttacccgtaaatccgacgttaagcaacaaagccaggaaaaagaaaagactacaaacgggtgtagcctatggacgttcctaaaattcatgtttttctttctatccttctgcttggtacatgataactgggccagtattaaaaactttatccgccggctatggaaaaaataaacctttatgtagcggtagaacagatgaagcggattaccatttccgggggtaccttttctatcaagttccggaaatggaaccgtcagacgcgggacggcggcgacatggtgatacttactgccgcccgtttgaggaaaaaggcgacggatgaaagcatcgaaaattcaagctataaactattcctgacggacaccacaacgggccggccgctgaattgctgggaatgtctggtaatggagttcaacgggaaaagaataacgatttaagattatggaaataagacgaagtggcaactttggaattatagataccggcaccgacaagggtttgatctccttttctatcggtggccgcggtaaaggttgggaaccttccagcatccagttaaaccggcggggggctttcttttcgcgaaagatcagcgtaaacggtacctttatcgttcccatgggtgacaataacgacatgccgggcgaggtcatgcgtttactggataaattctacgccggtgaaggtattatgggtaaaatagccggtttacagtggggagaaggcccgcggctgtatgaggatgcgatcgacgaagagaataaccgtttttaccggcgttggaaactcgatccggaaataaccgccgacctggagtcgtgggattacacgacggttcttcaccgctcactcgtagacttaacacacatgcagggcttttttataaagtttgtccggaaccgtgcgccgcgtgtaggcaatcccgggcgtttggtacggctggaacatattccctaccagaaggcccgcctggtatatcctcccgacggcgaggatgaaccgcaggaagtacttgtgggcgactttccttatcctgatccggcctatacttaccgttacccggtctttgatccggcccacccgttcaaatatccggtttctgtgaaatattataatatctattccttttgcaaggattttatgagtacaccgcgttttttgggtgcgcttgactggctggagcttgccggcggtctggccgctatcctgatcgcctataacgaaaacgcttcggccatttccctgcatatcgaatcgccgcagtcttactgggaccgcgcggaagcacgtataaaacaggtttgcgagcgtacgggcgagaaatacacggcccagatgctggaagatttcaaggacgaagctatggagaaattcgcctccaacattaccggaaggcagaacgccggaaaatacatgcacacgaccaaattctggaatccggaagcgaataactttgagggctggacggtggaaccactggataagaagataaaggattatgtggacgcccagattaagatatccaataaggcggacgctgccgccacttccggcttcggtcttgatccggtactttcaaatctgattatagaaaacaaactttcttccggatcggagaaattatacagcctgaaagtgtataacgcttctgaaacggctattccggacatgatcctttgtaagccgttacagcagtatattaatgccaactttccgggtaccgcaacgaaagtagggctttatcgtaccatagtggaagcggaacagaacgtttcaccctctaaccgtatgaaagaaaatgcgtagtctgttttttacaccgaaaccggaagatgtgccggaagaaccggtaagcgaccggcaaccggaagagaaccgggccgataacaccccggataagcatataaaggcccgccggacgaaaaacgttcattttgaccggcggataaaatcggagctgcacctggaagagtgtttgccctggcattttgagaaaggggcgtcttatcactgtatcagtcatggggacgttgacagccttacttatcttcgtgtgatcgtgaagcaacaaccggtggaatatgttctgatttctacctggtgtatggcaattaccgatgttaaggaggtggagaaatggctggagagaaaagacatagggcacgcggatttttatgtaggtgaaatctttcaaggttcctacgcggatgtttatttatacctaaagaaggtggcggaacgtttcggatcacgtgtctgcatcttccgtaatcatgctaaagtaatggccggttttggtaacgcttttgattttgtaatagaaagctcggccaatgtgaacaccaatccgcgcacggagcagacctgtataacgatagataccgggctggcccgcttttataaggagttctacgatgaaataaacaatttcacaaaggattttgataattggaaaccatatacattaaaaagagaccgagcaaatgacgaagttatttaataaaggcggtgacggtgccggtgaaatagtccgtgttctgggattgatcgataatgatcttgattttaccaagtgggaacctatcttaccgctgggtattcgggatttacaggctatcatcggaacggaacccatagacgcggtagataagtattaccgtgaagatcatgcggacggtacggaaccggacggcatggcggaaactttgcggctgatgcagcaggcggtggcaatgtttacctggttaaaggtcattcccactttagacgcacaacacggaacggccggacgtggcaaacaccttggagagaatgaaacgggtatgaccgccttacaggagttcaaggatgaagagaatatccggaacctggcttatgaagccgtagacgcgttggtggagttaatggaccgcgaaaagtttgatttctggatgaacggcattaagaaaaaggctataaaccggcttctaatccagaataaggaaacgttcgatgaatattacaatatcggcagtcaccggctttttctggtgcttattcctatgatccgggaagtccaggacgggcagataatacctgttatcacccggaaccgttataataaactgattgaaggcgataccgttttaacggagaaattgctggagtatgtacgccgcccgcttgcacttctcaccataaaaaaggccgttgaacgtttaccggtggaagttctacccaatggaatcgtacaggtacagcagagcacaaccgtacgggataaattgcgggcggaaaaagaggcccggcaatcggttgctaacagtctggagcaggacgcggcggcttacctggatgtattgcaggatatcatcagggaactggatgcgcagtcggaaacggtggattactatataccgggtgttaccgtacaatccaaaggaataaccttttaatgtccggacatggagaagtttacatataatagtaagacggcggaggttccttcatgcctggatgaagtcagcagtgagcagtaccggcagtttcttatattgtcggtactgatgaaccgcggtacgatcagccccggacagttccgcgtaaaatggctttctttccttctgggcatgaaagcggattacaccatgtaccggcgtgagatcatccgggagctggacggccaactggaaaagctggacggctttttctcttatacgaccggtaaggagggcgagcggatcgttacgcccattctgaaaaccgggcgtaacctgatgcaggattttgggagctggcatggtgtcggtgacatgctgaacggtcttactttcggtaacttttgtgattgcctggatttgttgcagcaaagcaagcaggcggcgacagaaaaagacgaaccggctataaatgaaatcttccaggatatcacattaaagctttaccggtacaaggacccggagaagatgccggccgttccttccttgcttgccattcatgcggtaaacttcttttccgctgtttgggaaatggttctttccggaccggtttatattggtggtgaagatattgactttcggatattatttcagaagttggcatccgaggaccggaaggcggacgataaaaccggctggaccggaatagtctttgaagtggcggcttccggcgtgttcggtaataagaaggaggtggacgatacacccttttgggatgtattactttatctgtataaatgtaagtttgagtatttacaccaaaaacgtaacaagaaatgagaacaacaacaggaacaaaaaacaagattaagcaatttgaggggctacgcctgaaagcgtatgtatgtgccgcgggagtatgtacgatcggttacggtcacacaaccggcgtaaaaccgggagatgttatcaccgaggcccgggccgacgctttctttgaatcggatatcagggcggtagaaaaccaggtaaacgcgcttccccttcatttgggacagtaccagtttgacgcggtagtaagcttttgctttaatgtaggtatcggaaaattcaagaaatcaacgctttataagaagatcagagcggatgcgtatgagccatccataccggcagagtttaaaaagtggatatacgggggcggtaagattcttccggggcttgttacccgccgtgaatgggaggcgaaacgttaccagggattgacaatatgatagatataaaggtttaccgtgaatactgggaaggcgtacaaaaacgtattcctgaaataaagaagatgctgcccgttaccattgacgaggaaatgagtaagacgatacagggactatctaaagaagaatgtccggtgctctttattctgatcccgtcgggaacgggtgccagcctttcggctgacaatgtgagggaaaataatttatgcgttattttccttatgagcaagtacgatccccaacggaaaggggcttatgagactatcgaagaggtacagccggttatggaacgtatcaaacaaatgctgatagaagattctgccaccggttgccctgtcactaaggaactggatttaaccagcctttccactcttccggaatccggcttttaccggacgtttgcagggtggagcctggctttctcatttaaaacaagattctaactgaatggccgagaattttaaaacggatttttttaccgaccggatcgggcgtggaatacaggacatatttcaagcccaactggatatcgctaccaaacggatttaccagaaaggccgtgagcgtaggaaagtacagggaaccggggagatcatacaagggcgatccggtgcattaatggccgcactacagaacccgaattattcggtcattccggacggcgaaggagtaatcgcacattctaaccttccattatatacccgcttcctggatatgaagaaacacggtaattaccagatttataaccggcagatatacgggattctatatcatgacacactcgggaagattaaatatgaatatcaggattatgtaagggaaaggataaaagaaatgtttgccagttcgctaaaataggtaataaaattaatacctaaatatttgtaggtaatgattttattacctatctttgtttcagtaaccaataaaacaaagtttatgcctgaaatttgtagattcttcggtattattatattcctctattggaaagatcataatccgccacatattcattttacttatggtgattatgaatgttctattagcgtattggatcggattgtagacggtcaggctccagctaaagttattgcaaaagtaaatgagtggattaacttgcacgaggcagaaatactttctctttgggaaaaggcccaaaaaggggaaaaaatagataaaattgaaccattaaaataaacgcttatgttacgggttatagatgtggattatattaggaattacgagcttcttgttactttcagcgacgggagtaaaaagatcgtaaatttggaaccttatcttacaggtgaggttttcggggagttattggataaggaaaaatttgttcaatatggtttaacccgtgctactattgaatgggccaatggtgccgaccttgcaccggagtttttatatgaaattggtatagctgcatatttttagaccctatgaatgattgtttagctattcaagataagaaggaagaaactttcttatatcggatttttatttctcacccggaactaaatgcttctgcggtggctcgacgtatgggaataagtcaaagccttatgtctcaatatataagtggaataaaaaagccctcacaagaacgggaggccctaatagtaaatactattaaagatatcggtaaagaactaacgatgattgtatgacatacgaagatattttatttttgatcggctttttcctggtaatattttttttcgtaggatgtaagcataaaccggctactttatccgggtggcttgcttttgcctttctttcctttatcgtgacgcctcttatatcggttcctctaacctggtacatttgctggatgatagatcgggcaacaattaaggataaagaatgttttgatccttcggattttacctttaagagataaaatactttcttcttagtataataagcctgtagaatggttctacgggctttttttgtgtccttttccgccactttacaccaggataattttgccttataaaatttactcttatggcaaaattaaaacctgactatatcgaatgggtgttaaccctgaacgcctccgatgcgcagaaggaaatacataatctttcagaaaagaacaaggagctccgggatagcaataaggagataaaaaaggctatgaccgatttaatcgccaccgggaaagctggcggtaaacaatggaaaaggcttgatgagcaactgaaagaaaataataagacgatcggcgagaataacaagaagattgccgaatgtgagaaacggctggataaaaccaccatgagtgccaaccagctggcaaggaaggcaaacgccttgcggaaagagcttcgcgatacggtgaaatccttgcagccggaaaaatatgccgccctggagaaggaactgaaagaagttgagaaagcatacgggcaggccacgaaaaaggcggaaggtttcggcggttcccttctttccctgaataagataaaaacggttctggccggtgtgtttgtcactatcggcgcaatgataaccggacagattgtcggcgggctaagggatgcgatcagtactattatagagttcgagaagaaaaacagtactttggccgctattctgggaaccacgaaaaagagtatcaaggatttaacagatgaagcgcgccggctgggtgctactacttcttatacggccgcacaggtaacggaacttcagatagagcttgccaagctgggattttttaaagaggatattaaagcgatgacgccttccgtgctgaaattcgctaaggctgtggacactgatcttgcctcggctgctacgcttgccggtgcaacattgcgtattttcaaccttgatgcggaagatacggaacgggctgtttctactatgactatgggatgtaacgcatccgctttaagcttcgagtacttaaatacggcaatgtctattgttgggccggttgctaattctttcggattcacgatcgaggaaacgaccgcccttttgggggctttggcaaacagcggtttcgacgcttcatcggcagcgacggcaacacgtaatattttgcttaacttggctgacggtagcggtaaacttgcacttgcccttggtggtcctgtagataacttagaagaccttgtaaaggggctgaaaaagctgaacagtgaaggaatagaccttaataaggcactggatttaacggataaacgttcggttgccgcatttaatacctttttaaatggtactgataccgttttaaatctccgtgatgcagtaacaggagccgaagagggatttaatgccatggcggaagaaatgggtgataatgtacaaggttccctcaatacattaagttcaactatcgaaggggtagttttacgtttctatgaatcaaagggtattcttcgggatttaatagaccttgttacgcttatggtggaaggtgtgggcggtatgatcgacatgtttaataaatggggtgttgtcacttataccgttaccgcttatttggtttcttactatggaggactgaaaatcgctaccatgtggcacgcccgttttaaaacggcgacccttgcttcggtcgttgcagagaaagcgcacgccgtacagctttatatcagccgggcggctactctggcttatgcggcggcccaggcattgctgcacctgaatattaaaagatgtaccgccgcccttcggttaatgaggatcgaacttttgaagaatccatatacggccctgctcgcgttactcgtggcagccggtgttgctatctaccagcttgcaaagaagacggaacaggcttcggcggcgatgaaggcccaccaggaagtcgtaaagaaagtgaatgaagaatatgccagccaggaagcaaaaataaaaactcttgtagctgctattaatgacgagaacctttccaactacacccgtaaacaaaggctcgctgaattaaaagaactgataccggattataatgcggaattgaatgaagaaggcaggctcataaacaacaacaaggaggctatagatcaatatttagtttccttggaaaaacaaatcaagttgaaagcttaccaggaggaactggaagaattgtacaagaaaaaaaggaatcttgaaagccaggaatcagagcaaagcgacgcttactgggacacccgccagcaaaatacattgtcaggatataaccggaacagtcttaccgctaaaataagccgtttatttggtacggaaaaagaggctaaccagttgaaagccctacagacaacacagaaggatttggccggtatagaatcagcaatcgcccagatcaataatgatatcttaaaaacagaggcgacggccacttcattaaccggaaccaataaagaaaatataaatactgaaacatccctcataaagaaactggaggccgaaaagaaaaaggttcaggaacagtgggcggaagacagcgaagcgaatatcgccaagaaaaacaaggaaatagaacgtatcgacaccgaaataaaacgtttaaacgaactggggaaggtcaaaaagaaggcggaagccggggagtataaaaatacggaaacggacgccacgttaaaacctctggagatcgagcacgaaaaacgtatgcttctaatcaaacagaaccgggagaaggaaaataagacggaagcccagtatattctcgaagggacggcggaaaaccttcgctattaccgggaacgtatcgacgcactccagaagctggaagcaaaaacgccggctaataaaaagaaattactcgatgaaatccacaagctcgaaacagaagcacagacggccatttttacggaaaccggcaagcaggaggacgcccgtataaaactggtacaggagaaacgggacgaacggttaaagattgaaaccgcctattacaatgtccagaaggacaccatggaaaaagcggtattaaaccaaagtatcacgcaggaagccgccgacgcctatatgctggaagttgaagcggagcacgccgcagaacttctggagataaaccgtacttaccagaatgatattgccgctttggaaattaccggtaaacagaaacgtatagaaacagcgacggaagcggccgacgccgtgcgtgagtctgaaatgaagttattgcgtgatcgggcggccattgctcaaaaagtacgtgaaataacttccgttccggtaggaataaccggtatgcaggaagcacaccggaaacaggttcaggatgtagaaacgacttataatgccataattgagatagcgaggcaggcgggaatttctaccgttggtttggagaaacagaaacagcaggaaattagccagcttgaatttgagtaccagaatagtttataccagattcaatcccagatcggcgtatcatgggcacaggaataccagaatgaactggccctgttaaagaatctgcacgatcaggaattaatagatgaaaagacataccagcgtaaaaagctgcaaatgcagatgaataacgctaaaaaatactttgactactattccggtctttcctcttccatggtggaagccattcaacaagccgaaatcgaccaggtggaagcaaaatacgatgttctcatacaggaagccgagaacaacggtgaagatactgccgccctggaagaagagaaggaaaataagaaactggagattcaaaagaagtacgcggatgtaaactttgctatcaagtgttcccagatcatagcagatacggccgtttcgattatgaaggcgtacgcggacctcgggccgattgccggaaccgttgctgcagtaatgcttgcggctaccggtgtggcccagcttgcatcggccaaggcagaacgggacaggattaaaaacatgtccttgaaaaacaccaccggcagcaagaccgccacggctgaacgtgttgtttccggttcttccggtggtgggtattatgaaggtggttacaccggtcccggcggacgttatgaagtggccggcgtggttcataagggggaatatgtggtaccacagccggaaatgaataatcctaaagtgatcgacgccgttagcactatcgaagcgatcaggcggcagcgtaccagtgccaacccgttaccacagaatccgggtgaatattatgaaggcggttacgtgacttcccctgcaggtgattcttcctaccgggagttcctggaagcggcaaaggagcttcgcgcctcctgtgaggctatcaaattgataaaggcctatatcgtttaccaggatttggagaaggccaaagaaactatagataacgcccgcgacacctttacacgcggaaaataagtaatcattatgctaaagattaagacgaacaaaggttatctggacttagggggtgactttaccgtacagatcgacgagaaatcccccgtcatgaacgaccggggatcacaaaccgtaccggtcacggttcccgtcactgccaacaatgcagggataaccggttttgcccaccggctcgacatgggtgtaaaaccgatgaatgaagatcagacatgtacggtattggacggggtgtataaacgtaccggaaagataaatatcgtttccgccggcaggacggaaggaattactttaaatatcggttttgacaattcggaagcctacagcgcctggaaagcaaagaaactgaactcgatcacattacccagcataagcggcggtaccgttagcggtcttatgtcctctataaactggttcttcacggattcccatgaagattttgccatatttcaaatagtagtcaaaaatgattccaaggacggcacgtattacccgcaatacataaaccgtatcactttggattcaaacggtgaatatgccttatgctatcaggcaaggacggaaacactactgataaatgataccccgaccgaaacgagtttaccggaagggtacggcgtggcccccttcttatacgtgcaccgtgtcctggactttatattttcagaatttggttatactataaccgaaaatccttttaagacggacaaggaactttccagcctggtaatcctgaacaatgccgccgactgttgcgtgacgggtatcctcaattatgccgatttaatgccggattgtacgattgaggactttttaaacgcgctgtatgtacgtttcggactggtttataatgtctcttccgatacgaaaacggccactttaagactgatccgggatataatggaagatgaacctgccgttgatctgtcccggaatctgacggcggaaccccttatcaattatgaaacggcccgtcagataaagttatcggccaaaacgtcttttaccggtgccgcgccttcggtggaacggtacgaggactatatcaaggggaacgaaaaaatggttatccgtgtaagccgtttcgatccttcccaggcctccgtgtggctgaactacgagaagaccaccggcaactggtacaaatgggattcgggcaacaagaagcatacgttatcatcatccagtttctttaactgggaccggaagacggaaaacgtagaggacgaggagctggcgagcgatgatgaatgcgtgtttatggattttgccccgaacggccttctttccccgtattacctggccgggtatgtgcaccgttatacctacctgaaaacctcttccgatgatgaagaggattcggaaaaggaggagacgccgctttccttcgctttcgcttttacaaaggccgttacggaaagtacggattattccttcggttctattttaccatacgctccggacggcggagaaattacgttaaaagacggcagcaaacatacgatatcgcttttattccagtttgaagacggtctgtttgccaagttctggcagaagtatgacgccgtattaaggcactcttttaaccaggtggacacaaacacccttttaccggttcaccagcttatgaaaatggatgtcttgaccccggtagccctgcgggggcagtacatgcttctggacggcctttcctattcgcttcctgcgggtaaactggtaccggtaaacattacgttgcgttccctgcgtctgatcggtccctataatctggataatgaacagggcattcccgtgtggggcggtgcttcctacgtgtgggtcgtatattcttccaatttgcagagtgtacaggccggaagggtggaatattgggaagattattaccgttatcactggatgtatgctgtgtacggttgccgtgtatcgaatacgatatatgacgggtatgttacgccgtcaacggatgaggatatattaaaaaatccgcccaccgcacaggataacatcatagaaaaaacttacaaatgtaagatagaggttgaaatcgaggtaaacgagcgttccggcgcggccaactatttttgttacgaaacggaagaagtcgaataccaggtaaggtttgtcgcatcgagggtgcttagctgatcccgtcctttattcttcctttgataaacccaacttttgcagcatggaaaagcagaataatatcatccttgccccgtcatcttcacaggtgacggagctttataagctttggagggaaaaccatgcggggcggctctcggacttttacaagttcctgacgtctcccacggatcagcgtgatcgtttcctttccggacttgaaaataagagtgagtttaacggaatattcatcgttaacacctttgaattatgagtttgacagcaaacattgatccgacggaaaacgcctttaccggaaaccctgtttatctttcggtagaaactacttctatggcgacttacaatataatgtatttcgtgaactttgaatttatgcgttccatatttaccggtaacggtaatggaagtttcaaggtgaatatcgcggaggtcctggaaacgctttttgttgatattcccccgttaacggacagttccgagatgttgataagcctttccgataaacggtataacaaggcggtcgccacgatcacccttcaaaatgaggaggaagaaacggccactttggttgttactgcctggcgtggcggtatatccaaacgggcttttaagaaattgcatgaagaaggtaataacatcttttctttgaagttcttgaatgaatcctgcaatttcttctttaccacccggagcaatgactggcgtataacgatgcgcgagacggaactttacccgctctgtttcatctatccggagcacgagctgaaaataacggaacttcttaccggacaaagccttgcagtaccaggcacggcagggaatttctacgccttgaacctggaggccgtaagacttaaattctttaccgattacggggtactggccaacctttttgacgtgtatagcggtgaaacgttcgctctccggatcgggatcgagcaaagcccgacggtccgcgagcgttaccggctccggttcctgaacagttacggggtttacgaggtgttttccctggaaggcgaggcgagcgtaactcccggcatggatgaagacgaagacgctgttttccggcgttacgatgaaattaccgatgattattattcggatcgcatacgtacggagatacaggaagccgtaacggttaagacgggattcaaacgcccgcaggaaatacgctttcttcttgacctgctttcctccgatgatgtctacctggcaggttacggccgggaagagatcaaggtaattccttcggcggaagagttttcttaccgtgtccgtccggacgcgccgcagaacgtgacgttaaagctcacgtttgccgagaaggagtccaactggacgggagaaatcacggaaagcggctaccggaaaccgcgggttcattccaaagagttcagtaaacaatttaattaatgtatctatatggcaacacaggagtatatcgatgatcttattatagtcattgaaaccgcggaggacgcggaaagcgttaccaaccaaatggtggcggcggttcttggcttcttgaacgaacacctgaaactggtttcccagggtaaggaaatcgaggcggaggaagccgcccgcattgccgccgatgcagccttgcagaaggctatcgacgccgtttctctacgtatcgaccggcttgtcggcaacaacgcttcgcaggcaatcgacaactttaacgaaattcttgcttttctggacgggcttaaagacagtgattcgctggccgcattgctggccgatatcaacgcccgtatcggcagcgaagacggttcacagagtgaagacggttccctttggggaaagctgaaaagtctgtcccaggatattagcagttgttccgaggacataagcacgttgcaggcagaccgtgacgaaatgaaacaggagttgcaggaaactgccgggcgtctgtcttccacctttaccaatgtaaacaacctcttgaacgccggcagcgtttatagtgatctgtcgggggtgtttgcagcattgaaaacggcggggaagattgacgatgtccggaaaaacggcgtgatcctttctttcctcactgccgacggctgggtgacgaaacaatttaaaggcaatccggacacggattttgagaatgtcgaaaagtgggaggatttcggcagcggcggttcaggcggcgggaatacctataatgtaaccggcagtgtgccgcttacggaaggtttctataccctggcttccgccattgccgcggtaccggagaagtggcgcggccgggggcgtgtcatcacctttgaaacatcgctcggcaaatgggagacgtaccagtttaccggaaccgccctggatgcctgggaccaggaggcgagctgggaagagttcggcggcaaaggaacggtaaagagcgtaacggtaaacggcgagaagcagacgccggacgcggccggtaatgtgaatgtaaacgtggatatcctggaagtggacgagactttgtccgccgattccaccaatccggtagaaaacaaggtagtaaccgcccgttttaacgaggtggacgcttccacgctgtttaacgtaaatgcggaggtaagcgaggatgaaacatccgtccgtctgtctttccagaacaaaagcggcgcggaaattaccgccgtggatatcccggccggttccggtggaggttccggcgaaacggtggctactaaaattgtcttgaatgcggctgtagataacgccataatcaaggaaggcggaaacgcccgtcttacttatacatacgatcaccaatacaccacgggggatgaaaagggggaatctaccgggcaaaaggcggatatcaccgttacgatcaggcgtggaacaactaccatgtattcccagacggtcagcgatgtttccaaaggcagttacgaactggacctttcaagttacttgcttgttgggaataccgatatttacgtagtggcaaccacaaccgatccgactaccggcaagaaacagacccgacaggcgtttacatccgtgaaggttgtcagcctttcccttaccagctcttacaatctggccggggccatagccgcaggcggttataccctggccgacacgattaatatcccttatgccgtgagcggttccggaacaaaggtcgtcacgctttatctgaacggccggcaacagaacgcgcacaccattacaagatcgggaacgacaaacggcagtttcagtttgtccccctcttcgcttgtgaccggccggaataccgttcaaatggttgccgaaatggaggcttccgccgatctcgtgttaaagtctgaaagtatctatattgatattctgaaatccggaggatcggcaccgttcatcggcacgatgatgagttttccggacggccgtatttttacggaggaccatcttgttccgcgcttggaagcggggcagtacgaacaggtaaaatttgactttgtggcttatgatcctgacgcaacgccggctcaaatggacgtttaccgggacggggtgaaaacgcagtctgtcagtgtggcccgtactacgcagacatataccaaccgttttacggagcagggcgagatcactatgaaatttaagacgggggccacggaatacccgttttatatcgacgtaacggaaagcgggatcgacttgcaggaaactaccgccgggcttgtactgaaactttcggcagccgggcggagcaacagcgaatccgatccgggagcctgggattatggcgacatacatacgacattttctggtttcgactggagcagcaacggctggacgggtgacgccctgaaacttacgggaggcgcgaagattgaaatcgggtaccggccgttctccacggatgcaaccactaccggggctacctatgaaatggaaattctttgttcgtcggtaacggaccggcagggggtgatactggactgtatggccggcgatatcggtttccagatgacaacggagcaggcccttatgcgtgtttccggcggtacggaagtaagtacgaagtttgcaagtgatatgaacctgaaaatggcctttattgtcggggccaaggccggtaagcggttgctggaactttatgtaaacggaatccgttgcggagcggtgcagtatggggctaccgaaggattactgcaggcggaaccggtgaacatccgtttgttcagtgatacggcggatgtggagatcaggaatttccgtatttataaccgtgcgcttacggatgatgaagaattgaacaattacatggtagaccggactacgtcggacgaaatggtcctgttatttgaaaagaatgatgttacgggggacaacggtacggatatcgacatagacaagttacgcgcccagggaaaggcggttatgcgaattgtcggcgatgtgaaccttgtcaacgccaccaataacaagaaattcgaggtaccggtcgatatctatttttatagcccgcagggtaaggagtacgattttgtagcaaggaatgtcggtctaagaatacagggtacatcatccaccacttatccgcgtaagaattaccgtctttatttcttgcgcctggaaaaatacggtaccacgctggaagttaacggcgtggatgtgccgtcccttgaatacagtttcaaaccgggagcacggccgatcagtatattctgtttgaaagcggacttttccgattcttccggtacacataataccggtgcggtgcgtattgtgaacgacgtttggaagaggtgcgggtggctgacaccgccgcaggctgcatataagggggaatatgacgtacgtataggcgtggacggtttccctatggacctgttttatgacaacgacggcaccggtgcgaatacttatctgggaaaatacaatttcaataatgagaagtcggaaagtgcgatcatttacggttttgaaggaattgaaggattcaacgacgaagcggccctgaacgggcagcgtaacaaatgtatctgtctggagttcctgaacaactccgaggccctttgtctgttcgggactaccgacatgtcttcttttgatgatgcgctggaatttcgtttcaaggcggacactacctgggcggatgcacacgaggacgacaaggcggcagttacaaggctttggaactggatcgattcatgtaaggatgatcccgccaagttcctggcggaatataaccagtatttcggtaatgacagcccgtttgcatggtatctgattaccgattactttatggctgtggataaccgggcaaaaaacatgatgctggcgacttgggactctctgatctggtatttccttccttacgatatggacacgctgttcggtgtgcgtaatgattcggtactgaaatacgaatataccattacccacgaaagttttgacgatagtatcggtagttatgcttttgccggccatgattccgttttatgggaactggtacggtcttgtccggacaaattgcgtgaagtggcggaaaccttgcgtagcaatatgagccttgaatatgtcctgcaagtatttaacgaggaacaaatgggcaactggtgcgagcggatttataacaaggattcggaatataaatatatccttccgcttaccgaaggggtgacaaccggcagcggaaccagttattataattatctgtatgccttgcagggaagccgttatgcgcaccgtacttataccattcagaaccgtttcgcccttttggatagtcagtatgtggccggtacttaccgtcgtgacagcttcgcggcttatttcggatacaagttcggcagcgataaccggaaaattcggattacggcctccgaacggtattattacgggtacgggtacacgtccggaacaccgcaccaaagcgcggtacttgcagaaacggccggggctgtggtggaactgacaatggacacggatttaattgtaaacgatccgcaatatttctacggtgcaagccgtattcgcgggcttgatctgacggatgtagcccacgccattgtcggcacgttgaacctgaacaactgcacggccttgcgtgaactgaatgttagttgtgaggccggacagacgacatttaacgcccttctggtgggtaattgccgtaatcttcgaaaactcgacatatccggacttaaatcttcttcctttaccggtatggacctttcaagtaataccaaacttgaaaccttcctggccggtgatacatcccttaccggtgtgacatttgccggcggtgcgcctctggccgtttgcgtccttcccggaactttgcagacgctcgaactccggtacctgaacaaactaaccaatgcagggctgcagctggaaggtacggcaaatatcacgcgccttgtgattgataactgtagcctgatcgactggaacacgttattacagcaatgcagtgcgaccagctatctacgaattaccggtatagatatggacgggaacggtaatttgcttcgcaggcttatgacaatgggcggcgttgatgaagacgggggaaacgtgcagacgtgccgcctggtaggtacgtaccggctcacccagtccatgtcggatgaagagtacgccgccacctgtgcacatttcccggaactgaatatcattcagccgcagtttgtcggtataaaaatagatcagacggtaggagacggggaaaagattacgaatctggataactctaccggatatgactataatactgaatttaccccgtcttcccatatattggaagtgttgtcgaaaagacgttgtattctggctaaaaagacggcggagggtgaaatgacctgttacccgcttcatgatgagaaccgaaataaatacgcggatagtgacagcgtggagaacgccacggatgcagtattaaccggatcggaaggtgaagtttacatatatgagcctcattactggtacaagggagtaacggacgtgctgaatcagtgcctttacggttttatttcaagtaatgaggatgcgccggcagcagcagggtacaccagtataagatttacccgcgaggaactggatgtgacggaagggatcgggattcgtaagaatacggattacacaaccattgaagaggcgaagaatgaatacgaatccggatcgttcgccctggtggacgtccgggattacaagcaggttcgttttcccggttttgcttctactctttacggtgctgtatttatagatgatgccgggaaaatagtaagtcggatcagcgtttcaaatgcgaacggttttatcaatggtatgtatctgttttgtgccgttcctgtaggggctacgaaactggcctttactttccttaattcggcggccttcgatttcgttttactcacaacatcggaaagtgtggaagcgatcgagccggactgggtagagcatacggaatgcctgggcggtgtttatgaagcctatctgattgatgatgtgctgcgttctgtcagtggtgtttcaagtgtaggaactatttcacagagccaggcagtcaaatacgcccagaacaggggcaaaggtttccagctgttcgactgggagatgcacaaggatgtgggtaatctgcatttctttaaatacggtaataccgattcgcagggagtttgcggatatggaacaaacaattaccagaaagtgacaggccttacaaatgcgctggggatgcgtgatacggtttcttattataaggaaaagggcggttccaatccacaggcggaaggtgcttaccgggacggtgtaaattatcagtccgtcaatgtgctgggatatgagaatttccagggaaacaaggcggaatggttgcagtatgtcacagtaaacaagacggcggcggacggaaggtggtttattaccatgccggacggaacggaacgcgttgtacagggaattactgtttataatgcggatatttatcctacccacatggtttggggccggtatatggatttgattgcggccaaggaaggcggttccacttcctctcattggttcgacaggttctatgtgggtaccgggctttctcgtgtggtgtgtcggtcgtactacaacgcgtacgcgtttggcggtgtttcgtatgcgagcgcgaattacggttcatcgggcacggatgcgggcgtcggcgttcggcttgccttcaggggcatcatacgctgggcgggtagcgtcgcggcctttaaagccataaatcaggcagattaagataaaaaatagcaacgtaaaacgttgtgcgggtagcgcaggcgtccggaagtaagacgggtgccggtgcttcctgaaagtacaaaggcggatttcctcatatacactcgtgtggtgtatcggtcgaacaacaacgcgaacgcgttaggcggtgtttcgtatgcgaacgcgaataacgattcatcgaacacgaatgcgaacatcggcgttcggcttgcaaacaattaggataaagaaaaagcgcataagccttaaagattggcgtacaacagtggggacgtgtccccggcgtggagccaagaggaatgagcctcgccaacagcagccgtttacggctggaaaggggaaaaataaagcgcagggcaatggggtttggtaggaatttttttcgaagaagcccggcccggggaattgaaggctaatttaattatcatgtggagagaagataatattatagaagagattgtcgaggactccaatatagaggacgccataaaaacggtattgcgcaaaagaagacgaaagcgcagctttgccgggcgtagaatactggcggatgtcccgaaggcagtagagaggatcaggcagcggatcaggagtgggcggttcaagctcggaggatatcgggaaatgaccgtagacgacgggccgaaggtaaggaccgtacaatcggtttccctggaggacaggatcgttcttaacgctgttatgaatgtggtggaccggcatttgaaagtacgttttatccggactacttccgcatccattaaaaacaggggaacgcatgaccttttacagtatatcgttaaagatataaaggatgatcccgaaggaaccctgttcgggtaccagttcgatataacgaaattctatgaaagcgtagaccaggacattttgctggatgcagtgaaaaagatgttcaaggataaaatattaatcggaatcctggaagagtgcatccgcatgatgcctaaaggcgtaagtatcgggctaagatcatcacaggggctttgtaatttgcttctatccatttacctggatcaccggttaaaggatcaggaggcagtagcacactattaccggtattgtgacgacggtctggtgctttccggtagtaagaaatacctttggaaggttagggatatcattcatgaacaggcccgtaaagcccgcctggagattaaaagcaatgataccgttttcccgatcaccgaaggtatcgacttcctgggatatgtaacccgcccggatcatgtacggttaaggaagcgtaacaaacaaaagttcgcccgcaagatgcacaaggttaaaagcaagaaacgcaggcaggagctgaccgcctcattttacgggcttacaaaacatgccgattgcaagaacttattttataaactaacaggaaagaaaatgaaaaaattaaaagatctgggctacaagtacaagcctaaagacggacggaaacgatttaccggggcaaggatcaagtcgcccgaactgatgaacaaggatgtgatcgtacttgattatgaaaaggatgttccgacgaaaaacggaaaccggactgttataaagctggaactcgacggcaaggagagaaagtattttaccagcctggaggaaacacttttcatttgtgaatcagcggcaagagacggagaactgccttttgaagcacattgcgaaggtgaagtaagtgaaaaaggattgataattatacattttacttgaaatgatacgaatttatgcagacagcaaggcggaaccggtaagatgtaccaaccgccgccggggaatctggcgtattacgtgggattaccaggaaacagagacagcagaaggagtgcagcgtagttacatggaagagacgttcgatcatctacccgcactggcagaaatcaaggcggttattaatgaatggtataaccggaagataaccgacacgatcgaaagcgggtacgtatggaacggcctgaaagtctggctttccatggagaaccagatgaattataagacggcgtacgatcttgccttgcagacaggcggggaaaaccttcctgttactttcaagctcggggaagaagacaacccgacgttttacgagtttgcaagtatgcagcaactacaagagttttacaccggtgccgtgaaacatatacaggagacacaaaaggaaggctgggaacttaaaaaggcgatagactggagcgtttatacgttggagtagaaaaagtgaagggggaagcgggaaacacgtttccccttcactcttttagttataacatatcatcaaaggcgtgtattcccgcttcgcgttcatcttccagagcatgtgcgtaaaccattgtcatagttatagaactatgtcccaaaaggtgggatagcgttacgatatcatgtgttttcttataatacaaggtagcgaatgtatgccgcccggtctttgaactgatatcctttgttattcctactttaccggctattgttttcaatacccggtttatatcctgatccgtgggaaggttcataaacaagttaccttttgtacgtccggcccggtaatattcatagatataacgtgccgggtccgataagggtacagttaccggtatttttgtcttacctcgtgtgtagtgtagttcattccctatgaactggtttatctgcaatgcttttgcatcgcctatatgcaaagaagtaaaacaaagaaacagaaaaaaacggagtacgttctgggtacattcttccaggcggccggaccggtacaaggcggtcagacggaggagttcttcttccgtcaggtatataacttcacttttggggcgacgtatctttatggccgcgaacgggtcctggtccatataaccgccgcgtatggcggcacctacatatattttgatagtagccatgttacgccatgccgtagaatccatgttacctattttgcgaagatatgcaaagaaagacaggagaaattcgtgggtaatctctgaaaatacaaggccgggtgcgaatgtttccagtttcttgatgatagaaacgtgatgtttccaggtaccgaaagaaatagttttgctaatttgtttgaggtaaacccgtgcaaaatcaaagaaggtaccaaaatcggagggattgttatactggcggaagaaactttcttttgtcagcgtctcatttttaagacgggcacggacaaatatatcgcttactcgtgaacggatattggagatgattaaatttttatccttactttctttgtcccggccttttatcacttcgttttgctcatcccattctttagaggtgacacttaaccttaccgcgatccttattttctcgcggttgatataaaattccacatacagggggagccggtcggttttgccttttttgccttgtcttacaactcttattgccgtcatttttatatgcctattttatgcctgtagaggggatatgcctacaaatatgcctacacaggcaggttattaaaagttaaacggggcgaaagtaaaacgtttaatatcagctatttaaaagaaaaatccgataacatttaactgttaccggatgttaatagtgattcccgtgtgattcgaaattgtccagattcctaaaaacgggataaagctaaacgcttccataattaactatgtccaccaaacagggataaacctgtatgatgcgacaaatatagtcaaaattccacgtcctacaaacgtttttcggggtgtcatggaacaaatttatataaaacttgatacccaacaaggatttcaggaaataacttcgatgaggcttcccaaacttttgatatcacttttgtcaatgtgacgtcactattagcctcatcactaaaaccattacctatccatccattaccaatctactccaatccattctattttaatcctatatgacattcttatattaccacctatcctctactcctacccctagcttgttacatcatttacgggtatcatccaactaatgtgaacaccctccccccattcttttttatgataacttggaaatggaatatcgactcttagcaatagcctcatcacatacttaatcatagagactcgtttttgagcgatattaaccattttatcccctaaccgagtaaattatactattaaggaataaaagtggcaatacgcttccaatagagatgaaagaagatatatacgcaggacaatagcctgcgtatattgacgaaagaggactttgatatatttcatatatccagtcctccttttatttttatgacctctcataatagtcttttatagaaaagttacccctaatcaaacactatttcccaaccattagaagtttatcttgcatagaacctaatagagggcttatttgaccgaagcactatcttcccgcacattataagcatcgggtgagttttcgaacttatccgttagatatgcctcaatcttatctgtcagctcttgcattaactctgtttttcccatagtaccactaaagtgcttcatagctcctctaattttatcctgtattcttttatggtattgtctatcctgtccatcctttttattgccattcgattcgccaagactccgttctctgacagagaaacgtccttttacaaaagaaggaagcccaacaacactatgagcaatacaaatacaccactcctcaaaatcactcagcgtttttatctgttcaaaagacacatcaaaaagcttatccgatattatacctatttcgtcataggagtagagccactcggataccaacctccaaaatatatctttatcatacaagtctttcgcttttagctgatgaccgaacatccgcctaattgcctttttaccaaagcatatctcgtatcttaataaattctgttccacacttgtagagaaagcaccgggagtattcttctgatttttccttttcttacgcacttctttggacttatcatagaaacgtaacaataccccattagaaggaaaataggtagtccctttccacttattagggcaacattcccccaaactttgcattttagaaatataaaattcagggggacgagacatttcaaagttttcagccatatccacccgttccacatcagcctctatcataggaacacctagctccttacccaattgcttgatagccttttcaacttgtgacaaggttaaagaatcgagattagtacctctgaaatatttagagaggctccccgtgactctgacatgtttctccgttacagagacacgtaatccgtttatatgtccgctaccaccttcaacttgcttgtactcgctggtttggtcaatcttattaaagacagacctccaatcgtacttatcgcctatatcctcttttagaagttttaaaactactgtgtcatacataactgattattttaaatgtatacaaataccactacttttataggttattatagatatacttggaagccaactccgattctttgcgttttataaactcatctttcgtttcctgtttccgagctgtcagccattctacaatttcatcacgtttgaataccaatttacgcccattagcgccggaacgatgacacggtatctcttttgtgcgagtccacttataaatcgtatgctttgcatagcctgtcaattcacaacaaataccaagaccaaatatctccggataatcttctatccgttttaatggtctactagacgtctgcgactcacttttaggaatatcacaagccatacccaacatattacaaacaacatcccgtaatgacattatcggagccaacactaaatactcccactctttccgcaaaaactctatgtcatgatagaaacatgcactttctaccgcatcctgatgatgttcatttataaagccatactttgcaatagattcatataaataatctactgacagtgcaattttaccagacttcaacaaataattttcttcatgataaatatcatctaactcttgaggtgttatttgtaatttacttcgattaaaagcagctaccctttcttcataaacggatataaaataactatccttccagttagcaaccatatcatctatgtctttcaatacttgccgaagtttacctttatccccattagttaaattttcaacataaagatagaacctcttctccgataatgccgttacttcccccttaaggagtttatctattaattttcccaagggtgtttttagcgttaaaatcatatcaaataagatttaataaattattataataacattgcaactctatccaaaacattctgtgacaaactatccaaatatgtcatggtggttttaatgtcacgatgtcccaatactgcgctaattgtttcgcgggaaacgtcattaccctgcaacgtcatagccatcgtatgacgactcacataggtggtaaggttcttctcaatacctaatatcttacctaatttcttcaggttattattaagtcgttgataacgggtacgtatatggtcatacagttgctctccgtcataatctttcgttattataggcaaaagataatttcccactaaagaagtattttgtttaaaccactccaatatatctttcaaggcaggggtaacaggtattattaacggcttcatgttcttgacattcttcgtcttttcccgtttataaacaatatgttctatcccttccgatacaactatattttcagtcgtaagctttgccatatcaacaaaactcatcccataacaataataggaaaataaaaacagcatacgggcacgctccaatacaaaattcgtttggggcgaattctttaaaagttccaaatcctttggctgtaaatagcgtttctccgtttcttcctccaaacaacctatttcaaaaccatttttaccgaatggataggttttcgatgaggcttcatgctcctttatcgccctgttcataaccgcccgtaatgttttaaggtaatatttacgggtattgccacagcacccgtctttttccatttccaaattaaaacgattgatatattttatatccaattctgaaaatacccgttccttaatcttcgggtcatactttgccaacatacgcagagttcgctcatacacctttgcatttccaatatgttttgtagctttcaaattctcgacctgcctcataaagtagtcataaaccttcccctgccttgacatacccaaaaattccgattcaaactgattcaaagtccaatctacacgctcttccaaaaacttccttaggatagtattttttcggtcttcataatgactcaacaacccattatataattcataattaggattgacacgcttatcattcttaaagcggcaagtatcttcattccactgcccctctaatgctgataattttaaatcaatgtacttgagcttaccttttttagacactctcaaacatacaggatagctcccgtcttttcttttgttgcttttgtacaacacaaatttaactgttgccatattattattttttatcctcccgacaaacattatttataaatattacaacacaaatatatacatcaaaaaatagatttatcagaaacaaaaacaatcattaacatgtaaattttcacaccacctcaccatgtttatcttctttatcaaagctgttaaacaatttactaaggttcaacttattaattagaaacacagaaccgatacattgttctattttttcataaaataaaggataaatacatctcatataattacaaatttccatttagcgaatctataattcctctgtgaaactttttaaaattacggaacataaagttacgaaatataactacagacgccacctattaattgtcatttacatacatatatatacataaattaaaagacagtaatgagattctgatgagaaaattcgattaaagttttattaaagtttttcggttaattgatatgatttagtcccacaactcagctatttgcataaactggaaaatgcaatatggaattaaatataagtccgtaacatctttttattctgcctctaccaacaaacaaaacaatcccacaatctactaataaccagccgatagcactaaatagtaaatttataatagaagaaatttcacgctatttatttgctaattaaaaattaatctgtacttttgcatccgcaattcggggtgtagctcagcccggttagagtacgcgtctggggggcgtgtggtcgctggttcgaatccagtcaccccgactggttaaagaggttagaaaccgaatgggttctaacctctttttattttagaaaacaatgaaagaagatcctagacatatccatatcagtgaatacagttatcctcttccggatgaacgtattgctaaattcccgttgcctacccgcgaccagtccaaactcttaatataccgtcgtggagaagttagtgaagatgttttcacttctttgccggaatatctgccgcaaggcagtctgatgatattcaataatacaaaagtcattcaggcacgcctccattttcgaaaagagacgggagcactgatcgaagtgttttgtcttgaaccgattcagccaaacgattatgtcttgaatttccaacagacagcacatgccgcctggctttgtatgatcggcaatctgaagaaatggaaagacggacaattgaaacgcgaaatgaccgtcaaaggattccctattaccctgaccgctacccgaggagaatgtaaaggaaccagccattgggtagattttgcatgggataatccggaagtgacgtttgccgatatccttgaagtattcggagaacttcctattcctccttacttaaaccgggatacggaagaaagtgacaaggaaacttatcagactgtttattctaagattaaaggttcggtagctgcgcctacggcgggattacatttcactccacgagtattggatgcacttcaagaaaaagggattgatcttgaagaattaactctacatgtaggagcaggcacattcaaacctgtaaaaagtgaagaaatcgaaggtcacgagatgcacacggaatatatatcggtcaaccggagtaccatcaaaaaactgattgaccatgacggttgtgctattgcagtaggaactacttctgtacggactctggaaagcctgtatcacattggagttacattggctgaaaatccgtatgctacggaagaagaactacgtgtcaaacaatggcagccttatgaaaagtacgaccagattcctcccgttgttgcgctgcaaaagatattaggatatctcgacaggaatggtttggaaacccttcacaccagtacacagattatcatagcaccgggatacaactataaaatagtgaaagcgatggttactaatttccatcagccgaaaagtaccttgttgcttttggtttcagcttttgtaaaagggaattggcgcactatttatgattatgcactggcgcatgatttccggttcctaagttatggagattcttctttattaataccataagatattctcctctctgaaagattttacgcaatataaaagacactatgccaagcgataataaccaagaaatgttccctatcgtagacgaacagggaaatatcaccggagccgccactcgcggagaatgtcacagcggtagcaaactgcttcatccggtagttcaccttcacgtattcaatgcccaaggagacatctacttacagaaacgtcccgaatggaaagacattcaaccggggaaatgggatacggctgtgggcggacatattgatttgggcgaaagcgtagaaatcgccctaaagagagaagtccgtgaagaattgggcatcacagacttcactcccgagcttctcaccagttatgtttttgaatccagccgtgaaaaagagcttgtttttgtccacaaaaccgtttatgaggaagaaatccatcccagcgacgaactggacggtggacgattttggaagatcgaagaaataaaagaaaatctgggtaaaggaatcttcactcccaacttcgaagaagagctgaaaaaagtctctcttattccttctctatccaagtaataatcttttcagagaacggactttctttcggagacacaactcccgcccaatgtccgttctcatcaatcataaacttctgaaagttccactgaaccggtgcgttttctttcccattctgttttttctccgtcaaccattggtaaagaggagccatatcttttcctttaacggaaatcttagccatcatcggaaaagtaacatcatagttcaaagaacagaacttggctatttcttcattactacccggttcttgtcccataaagttattcgccggaaaaccgataacaacaaagtctttttctttatatttctcatatagtttctccagttgagcatactggggcgtcagcccacacttagatgccacgttgactaccagcactttcttacctttcagtgaagaaagaggaaagtccttaccatcaatagttttcactgtaaaatcataaaaagacttgttttgcgcttccgaagaaattgcaaacaacaggcttaccatcatcaagacgaatgttttcatgttgaatatacatttagtttgtttttatattaaacgagtaaactgaaagaaatgtttgttcagcagtgaaacaagaacaatgattttacatctttcaattccccaatccgccacttcaccccacaatctttccgcttcatttatttttagtgataacggatgaagataggtagtaattttgtatcgtgaaataataatacaacgaaagtcatgtttacagctattgtacgtttttcaatcaagaagaaactatttgtaggactcactactctcttcctgtttatcggaggtatctatgcgatgctgacactacctattgatgccgtgcccgacattaccaataatcaggtacaaatagtgaccgtatcccctacactcgcgccacaagaggtggaacaactcatcactatgcctatcgaaatagcgatgagcaatattatgaatgtcgaagatatccgttctgtcagccgcttcgggctatcggtcgtaacggtcgtttttaaagaaagtgttcccacactcgatgcacggcagttgataaatgaacaaatacaaagcgtaacaagcgagattccctccgaactcggaacaccggaaatgatgcccatcaccaccggtctgggagagatttaccagtatatattgaaggtagctcccggatatgaaaagaaatatgacgcaatggaactccgcaccattcaagactggatggtgaaacgtcagttgtccggtatccccggtatagtagaaatcaatagtttcggcggttacctgaaacaatatgaagtagccgtcgacccggacgcccttttttctttgaatatcactatcggcgaggtgttcgaagcacttagcagcaacaaccaaaataccggcggaagctacattgagaagataaagaacgcctactatatccggtcggaaggtatgattacccgcatcaaggatattgaacagattgtagtgaccaaccgaaatgggattccggtacatatcagtgatgtaggagttgtccgcttcggctctccaaagcgtttcggtgccatgacaaaggatggtgagggcgagtgtgtcggcggaattgccatgatgctgaaaggtgccaacgcaaatgtagtgactcaagaactcgaaaaacgggtagaaaaaatacagcagctattacccgaaggagtcagtatagaaccttacttgaaccgttcggaactggtaaaccggaacatctctacggttgtcaacaacctgattgaaggagcggttatcgtcttccttgtactcatcctcttcctcggcaacctccgtgccggactgattgtagcatccgtcatcccgctggcaatgctcttcgcttttatcatgatgcgtgtattcaatgtcaccgccaatctgatgagtcttggcgccattgactttggtattgtagtagatggctctatcgttatcttggaaggtatcctcgcccacatttacggaaaacaattccgaggccgcacactgacccgcaaagagatggacaaagaagtggaaaaaggagcttccggcgttgcacgttcggccacttttgcagtgttgattatccttatcgtcttcttccccatccttacattgaacgggattgaagggaaatatttcactcctatggctaaaacacttgtgttctgcattatcggagccttaattctttcactgacttatgttcctatgatggcctccctctttctgaagcataccattgttgtgaaacccacccttgccgaccgcttcttcgagaaactgaacaagatctaccagcacaccctgcgagcctgtcttcatcacaaatggcgtaccgtcatcgtagccttctccgtgctgatcggttcactttttctctttacccgcctgggagcagagttcattcctactttggacgaaggagattttgccatgcaaatgacactacccgcaggaagttcgctgaccgaaagtatcgaagtatcccgcttggcagaaaaagcattaatggataaattccctgaaatcaaacatgttgtagccaaaataggaacggcagaagttcccactgacccgatggcagtggaagatgccgatgtgatgattatcatgaaaccattcaaagaatggacaagtgccggaagccgtgcagaaatggtggataaaatgaaagacgcacttgctccgctctccgaacgtgccgaattcaacttctcgcaaccgatacagcttcgcttcaacgagctgatgacgggagcaaaagcagatattgccatcaaattatatggagaagacacgcacgaattatatgaaagagccaaagaagcagctacctttgtagaaaaagtgccgggagcagcggatgtcatcgttgagcagacgatgggattacctcaattggtagtgaaatacaaccgtggcaaaatagcccgttacggcatcaacatacaagagcttaacaccattatccgaactgcctatgccggagagtcagcaggtgtaatctttgaaaacgagcggagattcgatctcgtggtccggcttgaccaggagaaagtggccgacttgaatcttgataagttgtttgtacgcacttcggaaggaattcaaatccctgttggagaggtagcaagcatcgaccttgtcagtggaccactgcaaatcaaccgggatgcaaccaaacggcgcatcgtcatcggtgtcaatgtgcgtgacgcagacatccagcaagttgtcgccaatattcaagagacattgaacaagaacatcaaactgaagccgggatattacttcgaatacggcggccagttcgaaaacttgcaaaatgccatcaataccttactggtggtcatccccgtagcattaatgctcattctattgattctgttcttcgcattcaagaacatcacctataccctgatggtattctcaaccgtccccctatcgctcatcggtggtatcgccgcactttggctacgcggacttccgtttagcatatcggccggagtaggattcatcgctttgttcggggtggcagtattgaatggtatcctgatggtaaatcacttcaacgaatttcgtaaacaaaatacctattccatgactacaaaccagattatcaaaagagggactccacacttgctccgtcctgtattcctgacaggactggttgcatctctgggattcgtcccgatggcaatagccacttcagccggcgcagaagtacaacgtccgttggcaacagtggtcatcggtggcttgattatttctaccgtactgactttactcatcattccggtgttttacaaaattgtaaattcatttgctacttggagacgtccgggaatcaaactacgctggcctttcgggggattgtgtctcctgttcttgtttcttcccgcgttcgtttccgctcaacagacacaaacagtcagtctcgaacaggcgatagaaatagccaaacaaaatcatcctcgcctgaaaatagccaataatgctattcaacaagccaaagccactcgcggagaagtgatagaagcaacgcctacctcgttcagctattcctggggtcaacttaacggagaaaacaaaaaagacaaggaactggctttcgagcaaagcctgggctctcttctaacgccattctacaagaatgcgttagtcaaccgtcaggtaaaaacgaacacctattatcggcagatggtagagaaagaaatcacagcagaagtgaaaagggcgtgggcctactaccaatatgccactaatctctgttcaatgtatcgagatcaggataaaatggcagaagaactgcagcgcatcggagaattacgataccaacaaggagagattaccttgctagagaaaaatatgatgaccaccatagctgccgatctgcataaccgctggttccaagcaaaagaagaagagaaaatggcattggcacgtttccaatggagttgctactccaacgatcccattgttccggtggattccactttatccttattctataccggcatttcggatggaaacctgtcgggagcacatactgcctactttcaaagccaggcagatgaagcgaaagcaatgctccgtgtagagcagagccatttctttcctgaaatcagtgtggggtatacacgtcaggacattctcccacttaagaatctgaatgcctggatgatcggggtttctttccccatctacttcctgccacaaaagagcaaagtgaagcaggcacggctaactgccacttcagcgcaaatacaggcagatgccaacatccgggagttaagaaataagacactcgaactggaagcatccctccgcagatataacgagagtttacgatattatacctcatcggccttgaaagaagcggacgaactgacaaaggcagccaacctgcaattgcagcagagcgaaacaggcattgccgaatatatacagtcgattaccaccgccagagagatacgcagaggctatattgaaacagtctaccaatacaatattgctgcactggaatatgaacttttcaagtaagtggaaaatcgagacattgaatgacatacatcacccagaataattattataaaacataagatatgaaaaagatagtttatcccatccttttactagttctaacggcttgcaaaggaaaccagcaaactacaaataacgaatccgccgcaattcccgttgccgaaacgatagcagataccatcgcacaacccgaagtggatgccatcacttcagctacctcaaagcctaatcaggtttcgttcaacggacgaatcgttcttcctcctcaacgtcaggcaaccattgctttgaccatgggaggcattgtaaaaaaggcttctctgcttccagggcaatgggtggctgcaaacagtgtaatcgccacgttagagaatccggagttcatcaccctgcaacaaacttatctggacagtcacgcacagaccgaatatctcttagccgaatacgaacggcaaaaaaatctgtctgccgaacaagcagcttctcaaaagaaattccagcaaagtaaagcggactttctctccatgaagagtcgccaggacgccgctgctgcacaactttctcttttaggcgttcaaacggaggcattacttaagaacggaatacaaccgctactggaagtcaaagcccccattagtggatatgccgctaatgtagcgatgaatatcggcaaatatatcaatccgggagaagcactttgcgaacttatcgataaaagcagcccgatgctttgcctgactacttacgagaaagatcttgcagacatacaagtcggcagcccggtacagtttcgtgtaaacggaatggggacacaaacctttcacggtatcgtgatttccatcggacaaaaagtagacgaaaccaatcgttcgctcgaagtgtatgcttccatcaaggaggaaaatgtacaattccgccccggtatgtatgtcacggcacacattcagaaacaataattgaccaactgtgacaacagcattgacattttataaccggtaactcataatttaccactatctttgttgtatgatagccaaagcaataaaaaaagataaatatatactttccacagtcatcatctccttagcggttgccgtactgattcattttcctgaatcagtatctcttttcgaccgtttcgaaagtcattccttattcccggggatgaagtttatagatgtggcaaacgaaatactgtttacctttctgtcactattgttactttttgccatcaatacccgtttgtttcatttcaatcaggcttccattaaaattacagggacaaagattttgctttcctttatcgtgacatggatattgagtaacttgtcaggacagttttttgttttccttcacagaacgtttgatattccggccatcgatgccatggtacatcattatttgcatccattgcgggattttattgtggcatgtctcgtcaccagtagttgctgcatccttcatcttatattcaagcagcaactggtacttatcgagaacgaacagcttcaggcagagaatctccgcaatcagtatgaagtactgaagaatcagctgaacccacacatgctgttcaactcgctgaataccctgcgttcgctggtacgcgaaaatcaggataaagcgcaggattacattcaggaactctcccgggtactaaggtatactttgcaaagtaatgagtcacaatgtgtcagtctccgggaagaaatggaatttgtttccgcttatatatttctattaaagatgcgttttgagaacaatctacaattcgacatacagataagcaatgcctacgaagaatatctcctccctccaatggcggtgcaagtgttgattgagaatgcagtaaagcacaacgaaatcagcaaccggaagccgttgaccattcatatcacgacggacgataacggcaatttgtctatcagcaacgacattcagcccaaatggactgcaacttccggaaccggtatcggacttgccaaccttgccaaacgatacaggctcttgtttaaacgggatatacaaataacggaggacagagagtttacagtttgtattcctttgattgaaaaatcacaactagaacaataaccaccatgaagattgtcattatagaagacgaaaaagcagcagtacgaaatctgacttcactgcttaatgaaataaaaccgaatggagaaatcgtgaccatactggatagtatcagttccactatcgaatggttcagttctcatccgatgccggaactggtattcatggatattcacctggcagatggttccgccttcgagatattcaatcatatcaatattacttgtccgattatctttacaactgcctatgatgaatatgcattacgcgcattcaaagtaaacagcatcgactacttattaaaacccatcggtaaggaagacatagaacacgctttcgataagctgcaaggtttacaggatgctgctgacaaacacctgtttccttttccacaacaggagaatgagctactgaaactgatacattcactccaaaagcaggaaaactataaaagtcatttccttattcctaccaaaggagacaaactattgcctgtctctgtagatatgatacaattgttttatattaaggactgtcaggtcaaggtagtcttaaccgatgaaaccgaatactgtttttctcaaacattagatgaacttacggagtgtctcaatccttctcttttctttcgggctaaccgccaatatcttatttcgcgagaagctatcaaagatattgacttatggttcaacagccgactgtccatcaacttgtattattcaggaatcaaagaaaaaatacttgtcagtaaagcccgagtagcagaatttaaagagtggttctctaagagaaagcgttgattccgaggctttgccttcttagaacaaatagcaaaacaaagtgtttcgtgccgtgaaacgattggtttcaacgcttgaaacaaagagtttcaagccgcaaaacactttgtttcaagcctatgaaactgcagtttcccgccttgaaaccaaaagtatcccctgttgaaacttctatttacataccagcttatgtttatatgcaggcatgttcatttcaaacggtgatagatgaagattaggtgatagatggagaacaacctatcaccgccctgaaagctcgatgaacaaggtgtttcagaaggatggtgatagattgaaagatgatttccatttttatgtatggaaagttagaatatgtgccatcattcaatgacagctgcaaagccaccatttctaaccatctttatagttagctgctccccggctttcacctgggatgacttgcaacgataatccatcgcctgacgtcctgcgttgataccatcctcaaaagatatcatttgataagagcgatctttattcaagaaatctaactttatggtaaactcacgttcctttttaccattattagtcattcctcctataaaccacttatcgcctttccgttttgctacaatgacgtattcacccgctttagcttccaatgccacagtctcgtcccatgttacgggaacttgtgtgatgaaacgggtacaatcttcattacgataataaagagtaggattatctgccaacatctgcagaccactctcaaaaaccacaaagagtgccaactgataagcacgtgttccgatacttgcagcattaggacgttccgaccgatacacattaggctgcatactaatcatcgccccgggagtataatccatcggaccgacagcattacgcataaatggtaaatacaaactattatccggataacaaccgcccatttgttccatgccacgcactccttcgtaagacagcacattcggatatttatattccagtccggcaggtttgaaagagccatgaaaatcgacaaacaaatgatgtttggctgcttcccgggctacccgttcgtaatagttgaccatccactgatcgcttctgtccataaaatcaatcttaagtccttttactccccattcattgaaagtcttgaagagatcaaaattgttttctaccgtcaaccatgtcaaccaaagcacaatccctacatttttttctttgccataacgaatcaactcgtgcaagtctactttgggattaggcgtataaggatcacgcgtacttttagcccagccttcatccataatgatatatggaataccaaatttagaagcaaaatcaatgtaatacttataagtatccaagttataaccggaaacaaaatccacatccggtccgtaaggagaagcgtcattccaccattcccagcttacctgtcccggcttaatccatgaaatatcctgaagttgattcttttcagccagtttataagtcattgtgttctcaatcaactgcttatcatttttacttatcacaaagtaacgccaaggataatttctcgtaccttttgttttagcaatgtaatcagcttcttgagtaatcttcacactacgatcactgttttcggcaaacgcaagcggagctttaggaaaaacagaaattgctccgttcgtgcccgttcctttgagaaacatacatggataatcagccagatccgactcgctgattaatattttatagtctttttgtgtgtcaatcaataccggcaaaacagctatccgttcttcaggcttccacgcattactttgaacatgtgtgtaaggttcctcataagctgtatggaagcctcccggttgttgcaagtgaagaagataatccgacgggaagttgatagcaaactcttcgttcattacttcaacatcacctttttgtgaggtaataaaccggtaagcaactccatcgtcaaaagcacggaattctactgaataatctttaaaggtcagtagcaattgattataacgattattgactttcgaatatttcaaaggaacaataggagttaattgctcgtcgacactccattgcttctgacgacgcaacttagggttctgtcccaacacttgatttttcagaaccaacaaaagagaattgtctttcaacaatacatctccgttataatctatactataatagattttatccgagagattcaaggacactttcagctctccattgggagaaaccaactctaaccggttctgcgcatgaagtagtgaaactaagcacaaacacacaactaacagaatatatcttctcatgatttagatatttaattaataatcgttttacattggcaaatgtaataaaaacatcacttcgtactatcaagcggactgggtaatactccttcaaaagtcattttcactggtttaatatacccgttttcatcaaaatacattcgatcaatacaagttgcacgactatttgctgctgtttcacctaacggacgacgatgataaacaatataccattcatcttctccggctccttttatcaccgaatgatgtcctgctccggtagctaccgaaagatcctgttccaggattttaccaacccttttgaacggaccaaagggagaatctgaaatggaatatgctacactatagttcgggagtccccagccaccttccgaccacatgaaataatattttccattacgtttcaacataaatggtccttctacatagttttccggagtgacttccttatacatcgttccgtcctcaaaaggaacaatactcaataagtcaggagccattttcaccatattacaatgtccccagccaccataatacatgtaatattgcccgtcatcatccttgaatacaaactgatcgataggttgagccccatgaacgatcttatcaatcagcggcttacccaaagcatccttaaaaggtccggcaggactatctgacgtagcaacaccaatccctcctacttcattattattctgaatatcattagctccgaaaaacaaataatacttatcattcgctgaaagcaccgctggcgcccaaagagcacgacgaagccaactgatattctcttttgatatgactttcggatgctttgtccagttcaccaagtctttagacgaaaaggcatccataaaggtttgttcatcataaggtgccgaatacgtaggatagatccaatattcatctccaaacacgactccttcgggatcggcataccaacctttaaaaacaggattaccactctttttcttttctgaaaaatttgcctgatatttcattgtctttccaggcaacgacaaagaaggagctaccgcttcatccgataccgcacgcttatagttcggtttactgctcatgacaaaacgtagtttcacgccatcacgtatatcctcatatttcaaataagacttgtcatacttcttgccgttcacatacaattcctttacatacacattcttcggcgaccaattatctgctaccatttcaatcacctttccgttactcatccgaacagttattgcctcaacgcaaggagaaccgatgttatacatattgcttgaaggagccaccgggtaaaagcctatgcaattgaacatataccaagccgacatctgtccgcaatcgtcattgccacttaatgcatccggagtatcgccatagaaacggtcagcaatcgtccgtacccacttctgacatttccaaggttctttcaagtaattataaagatacgctacatgatggcaaggttcatttccatgccaataggctccgatacggccttgaatatcatgtgctcccggaatgtcatccggcaactctactgtgaacagttcgtccaaccggttgcggaaccagttttcgccagcttcgttgatatatccttgtacatcttgtggtacgtaccaggtatattgtacagtaaagccttccgtaatatccccccatccatttacagatccggggccctgataagctaccggagtaaacggtgtacgccagtttccctgactgtccttgccacgcatatacttcgtttccggatcaatcaaagtctgataagagagtgcacgattcaagaaataacgataatcatcctctttacccaaagccttggcagcctgtgccatacaataatcatcatacgcatattccaatgttttagatactgattccgcctctttatcgaaaggcacatatcccatcatacgatactccggcaaacagtcataattcggattcatcgccgtggtcttcatagcctcatacgcacgttcgtaatcgaacccttttactcccttcacaatcatgtcagccaatacggaaactgcatgataaccaatcatacaccaagtctcatttccataaaacgaccagacaggcagcattttctccacacttttatcataatgagccaacatggaattggcaatatcggcattcacttcctgctgcaccagattgaaccagggatgcaaagcccggtaggtatcccaaagagagaataccgtatagttggtaaatccttcggctttctctatatttttatctaatcctcgaaactgcccgtctacatcctgaaagatgaacggatgcaaagccgcatgataagccgacgtatagaatgttcttttcgttttacggtcggcagtaagggtatattttccaagttctttttcccacagtgcttctcctttagctttcagttcatcgaaagcgagtccggcaagttccgccatattgttctttgccccgtttgtgctgaccgatgaaatagcagtttttacaatcacttcctctccggctttcgtatcaaaagagatgcaagccatcaaattctttccccaggcttcatagctgctacgaaaccgggaggtattgtaaatcaccggtttcttattctgcataaagcgcaaaccggtcaactttttagagaaagtagccgtgaaataaatatgccgttccggtccccagccttttaccagtttatatccggtgatggtggaatcattttccatgcgcagattcgcccattcacaagattgccataaagtatggttcatatcgatcataataaaagctttatccgattgaggataggtgaagcgaaacataccactacgtactcctgacgtcatttcagcctttactccataatctgacagctccaccgcataataattaggtgatgcccattccttctcatgagaataacgtgaacggtatcccttttccggctcctcacgtgtccctggatccagtttcatctctcctgttccgggaataaacagaaagtctcccaaatcaggtataccagtcccgcttaaatgagtcaggctgaatcccaacaaggtggaatgattatatttataaccagaagccgcatcatagtatttactatctgtgtccggactcatctgaattcctccgaaaggaatctgcgcacccggatacacattaccataaccatctgttcccacaaatggattcacataatcaatcagtttctcggtttgagccatgcccggcaaaatactcaccagacacgaccaaaccaaaaacaatctctttttacccaatctactagccatatttattcttattgtgcttgtacatctcctaccgcaacttgatattcgtgccacagttcatcaatattatattcattccctaaaatatgtttgatagcaccatcaaacgaccaaggcaccacctccaacgtactgcgattgaacttacgcaagaattcagggtctttgttatcacgcagccagacaaagaaataaccggccgtacgataaccgtccatatagttcccaccttttggacgggcattaggaccatcgaaaccaccgtttgccacacgtacagcatcggccatgccttcaataaatgcccagaaaacacggttagtcccataagaaccaattccttgcggttccagctgataggcatgtgtcagttcgtgcagcaatactccgcgcgtttcgaaaaacagctttgccgtatcattcttcgcaaatgatttctcaatatgccgcgtgctatagaagattgtgacatcaccattaccaccacctttagcagaaacgccttcaatatcttccaacgtataatgtatcttgttcactgtcggaatactatcatccggagaattataaagggtagccaatacctcacgtgcctgggccttgatatacgattccgcatcggggataatccggtgatagacatcagaacctttcgtttccggtgctttatcttcaaacaggatagtgcccacattatattttccccatgtgtcagtcacaacttcagcctgattctttgaagttgcagaacaagctcccatagcgattagcatacaggtaacatagatcaagtttctctttttcatatctttattttattatttattgattccatcggttaacgagtaaggtttgtctcctttcgccagaccacgacgtttgttgggcgatgcggacatcttaaactccaatactccaccttttaatatatcctcgtgtgtaatgtacatcttatcatatactttcccgttcagtttcagagactgaacataacgcttcttgtcactgacgtccggtgctttgatctccaatgtattgccattgggaagtttcaacttcagataaggcaaatacggggctcccagtacatactcgtctgttccgggacaaaccggatagaaacccattacggagaaaagataccaagcagacatctgtccgcagtcgtcattgccacccagtccgttgatgtcattacgatacatcttattcaggatttcacgcaaccagtactgtgttttccaaggttcagaggtccatgcatagagataaggaatatgatggctgggttcattgccatgcacatatccgccaaccaggcattcttccgttatatcttcgttgtgctcataatacttttccggcagatgcatggagaacagcttatccagtttgtctacaaacactctctcccctcccatcaggtccatcatgccaaatacgtcatggggcacatggaaagagaagttccaggaatttccctcaatgaacccctcaccataggtctgcaacacatcaaagtccttcttgaatgaaccgccactaaatcggggacgggcaaaaccaatcgtcgtgtcatagatattacggtagttcaaagcacgcttccgatacgtttcggcaatctctttctttccggattttaaggcagtctgatagatggtccagtcatcatacgcatattccaacgtggaggaagctgccgtaccgcttttgtccaacgggatatagcccagtttcatatagtccgccactccttcgtaataaggtacagtagaagtactgaccattgcgtccaaagcctcgtctacattggaaaaaattcctttagttatggcatccgccaacaccgatacggcatggtagccactcatacaccagttctcattacccatcagactccagacaggcaacatcctgtgcacactttgctgttcatgcttaatcattgactccaccatgtccacactacgttccggcttcactagattcaggaacggatgttccgcacggtaggtatcccagagtgaaaatatcgtgtagttggtgaagccttttgcctgatggatattgtgatccaagccacgataagatccgtctacgtccatatagaccgatggattaatcatcgtatgataaagcgaagtgtagagcattgctttctggtctgcagttccttccgcctcaaaatgatcgagttcattgttccagtccgttcgggcggcttctgccagttcttcaaagctttttctggaagcttcggcatgtagattcttgatagctccctcggtactgacagccgacaatgccacctttacgaccagttcggattctttgactgtatcaaagttgaagtaagccacaatcttgcgtcctgtaatctccggaaaattcttttccatattgaaacgacgccagaagccattataacgcactttttctttgtccttatacccatattcccttataggttgtgaaagagaaattgcaaaataagtatagttggttcttgcccatccgtttgttatgcgatagcccgtaagcaaggtatcattttcaacccgcaggtttgcccatagtaccttaccgtcataattatagataccatgtaccaagtccagaatcagatgaccgtcttttcctttcgggaaggtatatttatgtatacccacacgttgcgttgcagtcaactgcgccttaatgccataatcatccagcatcacttcataatatccgggagcagctttttccgtggcatggctgaaacgggaacggtatccttcgtccgggtaatccgccctgccgggattcagtttcagttcacctacggcaggcatcagtaaaatatcgcccaggtccgaatgtccggttccgctaaggtgtgtatggctaaaacccacaattgtcttatcacgatattgataaccggcgcaatactcataggcgttcttctgataggctccgtttacgttatgtggaattgtgtctgtatccgggctcaactgtacccatccgaaaggtgtgcaagcaccgggaaaggtatgccccataccattagtaccaattatcggattcacataatccactggttgttgagccatggcggacgatactgtaaccgccgccatagccattatccctaatctcttctttatacccatatccagttagttttagtcgcgagagaaagaatacggataatctgattcattcacacctcttcccatattgggtttattatccatattaaatagcagtcgcccgccctttaataaatcaaaatggttcaaatagttcttcgtatagttcttgccattatagttcaatgaacggatataacggttttcatcactgttcttgggagcagagatttccagcttcttcccgttttccaatgtaatagttgtctttttgaaatagggagctcccagcacatattcattgctgcccggacataccggatagaagcctaaggccgtaaagacataccaggcggaggtctgtccgttatcctcatcaccacaatagccatccggggtagcaaagtacaggcgggtcatcacctcacgcaaccagtattgtgctttccagggttcgccggcataattatacaggtaaatcatgtgttggataggttgattaccatgcgcgtaattccccatattggcaatttccatttcgcggatttcatgaatgactccaccgtagtaactgtcgtcgaataccggtggaaggctgaatacggaatcgagcatactgacaaacatcttcttaccgcccatcaggtcgaccagtccttgtacgtcatggaacaccgaccaggtatagtgccagctatttccttcggtaaaggcatctccccatttaaacggattgaaaggagactggaacgtaccgtcggcattctttccacgcatcagtttcgtttccgggtcaaacaggttgcgatagttctgacttctttttttataaacttccagttcctcggcaggacgtcccagtttctcgcccatacgatagatacaccagtcatcataagcatattccagcgtacgtgcagcactctcattgatctttacatcgtatggtacgtaacccattttattataatattcatatccacgacgtccggtagtggaaactcgcggatgtacactgttggcacctttcagtaagccttcgtacattttttctgcatccgctttggttacattcttcataaaggcatccgccactactgaagcagagttgttgccaaccatacaccctctgtgtcccggactagcccattcgggaaaaaagccgctttcctgataagtattcaacaaaccttcctgcattttttctcccatggaaggatatacaaggttcacaaacggaaacaggcaacggaaggtatcccagaatccggtatcggtaaacatatagcccggacggacttcgccgttgtaaggactgtaatgaactgtttcgccctgcgcatttacttcatagaacatacgggggaaaagcacggaacgatacagacaggagtagaatgtacgcatacggttttcatcattgtcttctatcttgatgcgtcccagcacgtcgttccaagccttacgccctgcttccttcgtctgctcgaaggttttcttgccgatttccttcaagttcagttctgcctgttcggggctgatgaacgaggaagcgaccttggcatgcacctgttcgcctttcttcgtggaaaaaccgatagctgctcccacatgattggactgcaactccagatgtttttctaccgtatgatagtctgcccagactttattgaacgtgaaaggtttgtcgaactctatcacgaaatagttcttaaagttccgtggaacgccgccgctgttgcgtgtcgtatatcccacgattttgttttcttcggggatcaccttcacatacgaaccgcgatcaaaagcatctatcacgatatacgcatctttcgtttcgggaaaagtgaaccggaaataagcacaacgttctgtcggagcaatttccgttgtcagattatattctgacaaataaacactataataataaggagttgccttctctgccttatgcgagaaccagcaggcacgctgctcctgatcaattctcaatcgtcccgtcattggcatgattgaaaactgtccgtagtcattgatccagggactaggctggtgggtttgcttgaagccacggattttatccgaagcgtaagtatatgcccagccatcacccattttgccagtctgcggcatccagaaattcatcccccacggcaatgcgatagcaggatatgtattcccattggataacgagattttagagtcggttcccatcaaaggattcacgtagtcgacaggttgtttctgcgcgaaaaggaaataagtgcccaataacagggcacctccgagagacaagagtttctttttattcatggtttgtgaattaagtataatattatatattactttattcggtgatattcataagcgagcacgaaaagaaatctatttattgttcatatttaatcaactgtaagaaccatttcacctcatcctcatttagtttttgaacatctttcaacagggcaggcaagtttttataactcttccaaaactcagcagacaaatcatccaaattctctggtgtgtaacgtatagcctccttgatgctgcccaatttgcaaaagtccggttgaaaaacaatataagaattacgatatttcaatttctccatcgccttagctacacgtttggcagcaccaaataatccatccaaattgacttcggaaacaggatattcaattgcaaccactttttctctattacaatctttctgcggaatatctaccaacagagcgaattcttcattcaggtaaacgaaatcttgtttctgtccgtctactgtcacactttcaggtatagccgaagcaagaacctttacctgataagaacgttgtgcaggcatttccttataagaacctttacgcggactaatagttagcgtcagttttgagcccgtcttttcagagtgaatagcagtcgtagcaaattccttctgataatttttatcatcgccattgtcctcgtacaatgtaaattcagaagaagtcttacccggaataacattcaaaacaatcgtttcatccttaccgttcagattcatcactttatcgttgtacatcggcagtaccgcacctgctttaatataaatggggtattcgtcaagagcgaaataacgagtcaatacttgtcccccttgcaacgtctttccggaagcaaattcataccattgtccctccggaagccatactttcacttcggtataaccatccttcataggtgaagttgcaggagctaccattacatcattaccaaacatatattgattgcggtaatcataagcttcttgcgtttccggataatcataatacattgggcgacagagtgacagtcctgtttcataagcctcacgagccattgtgtaaatataaggtaccatattataacgctggcgaatgatgccacgcaaaatatcagatacctcattactaaatacccaaggctcttttgtcaaaccagcaatcttcgtactatgtgaacgtaaaataggactaaaagcgccaaattgcatccaacgaacatacaattccggatcaatatggtctacaccctggtgacctcctatatcatgactccaataaccataaagtacattactggcagtagagttgaagtaagtctggtaatcgagactagcccaggaaataaatgtatcacccgaaaagcccacctgataacgatgatttccaagtcctccccaacgatgataaatcaatggacgcgtctgacgttcacgctccatttgggagaaaaatatataattcagccaccaagtattacttagatttttcacttctttatcaaatggttcctgctgccaatccagccaccaaaaatctattccggcattgttcataggcattagaacattcttgaacatactttttatgaaactcttttttgaagatatccaaggtatttcctgtttagtagccggatccactccattatcacgcgccacagcttcatattgttcttcgtaactacggactccttctgcaggatgcaggttaagggtaacacgtagtccattgtcagctttcaaatctttaaggagtttacgataatcaggaaacaactctttgttccatgtccatccggtccaactcccccgtcccttatctgtataatgccagtccatatctattacaagcacatccaaaggaatattatagttttcaaaattcttgcataattctcgcaattcatgatcactatacatccaataacgactccaccaataaccgaaagcataacggggaggaagaggcatacggccggcaaaaagagtatagtctttcaatgcagctttataatcatgtccataagccataaaataccagtcttgagccccctcaacatgttcacgagtcttcacccaattccagttatccgcatcaccatcgaaaagaaaattgttggagtcatctaagcaagtccacccgtctttagcaagaagcccatcttccaaatccgctttgtgcccccaacacttatccccgtcccatccgtcaagtgtacgagtcgtgcctttcagattatactgttgcttcatacctggcttccaaacgaaagcaggtgtcaaccctttcatcgaagaaatctgaagattctcggcagtgaaagcaccactattttttttataacgcagtttcattttagaggtagaaagctcaatccatgcacctttctttagtttgaatttaactgccggataattacgttctacagccaagaaagagtgttgattaatgaatttaccatcaggagcatactccatacgaattgtaccgtcagaaatgactgtaaaacgtacattcgtatcctcataggcaacgttattcgatttttcttgtgcacccaaggaaattgaaaagaaagttatcaaaaagaacaagtaaaagttcttcatctgcttgaattttgaataatgaataattggtttggtttagaatattaaggcatctcttccacttttcatgcaaaaatacaaaaaaagaaagaagagatgtttgaatttacacagaatcaatctctggtaacatgaatgacagccgttttcacactgccttcttcggctaaagcagtagaaatagacagatcaataggagttgcagtgatgctaataacaacatcataggtacctgtttgtgtaaagccagcttttgtcaagtagtcttttaattgaactttacttatggtcatactcaacacattaagttcttcttcaactgtcacctcgttgttcaagacttctgtgacaatattctctgtatcagaatcactggctttagtaaatgctaccgtataagtggcattacctacatctacccaacggaaagctataaattgaggagtggtaagatctgtcatgtccaacgtatactcatcggcctctataattaaacttttaggtgaaggaacaccggccccatcttcgtcaacgcaagactgaaagcccacaaatagtagtaaagatactaccaaacgatataaatgtttcattgtaatcaagatttatagtattcaagttttgaagccggaattcttccggcttccattcttttattagtttgcaggaacaaactctgtatgcatatctttcacatccaaacagaaagtaaacttgtaacgaccacttacagtaggaacccacttgaggtcaccgccatctttttccagacgatactttgtcaagtcatgatttgttaacggatcggtagcggcctccggagcaaagaagaacggatcttcaccccaacttgaacctccaagactgatttttatttcaccgccagcattgaactcacctgtccaagaatacaggtgtggattacgagcattctctattttgaaaagaccatcaccactattaagagtccaaccaacagaacaaccattacctaccatatacattgtttcaggaacaggtagttctaaaatttccatcatacggcaatcattataatcgttattagtgtccacaatgaaagtgcgacgtcctgtttctgtattagtaaattctgtaatttcaccctcattcaaatagaccatatgaagaccatctccactattaccgtaggcaggataatctccacctgctactgtaataaaatgatacgcacaaggagtcacatcaaatgtaccctcataaataccggttcccatgttgcgttgtcctagccgttgagttgagactttaccctcattatctgtcatgtgaatgtaaatataagtaggatacttctcataacccgacacagtaaattctaccgtggacgattccggctttatgtatttgtccgcattatgaacggtacaaacgacttgtgcagtaactttaacctcttgccccggtaacacccaagtaccaataatagcattaagttcatcatgcgtgaaactctttttccgatcagtatccaattcataaaaatcggtattatttgcacttttatttgccgtagcatacaaacgtaacgagtaggtcactaagtcagtctcattgaccggactactagcggcatcccaagtaaaggttatcgcagtttcgtcttcctttcctttatccaacaccagcttatcggtagaagctacaatatgcatctcgtcaggctgttcgtccagcgtgaagtactctggatcttcattacaggctgtcgccactcctaatatgctgcacaaccccattatttgatagaatatcttcttcataattttttacttcattaaataattgattgttattcactattcgagccagaacggagtttgcaccaaattcgggttcttctcatattcatcaataaagactggcatccaatagtaacatcttttccatacacgagtctgataaacggtacgtttgaagaaagtctcattggtagttccctctgaattcataccataatcatcaccaatcatttccggtgtattttccacatctttccaacgacgaagatcgtaccagcgattgttctccaaacaaagttctacacgacgttcagctttgacaactttacgcacagctgcttgcgtgttctctatatgtataaaattctcatccaagtcagagacagcgtcaaatgtgtactgacgcacacctgcccgttctcttaccttatttaaatattttaagcacaattcacgggcagcacttgtatcataggcctcattattagcttcggcataatccaaataagtgaaagccaaccgataagtgaaaccttgacgactagtatatacacctgtttttttgttatcggtcatacaaagactcttacgaaccaaataaccattttgaggagcatcatgaggcgagctggtacgaatattgtcttttccgttgtagaagaagtcatacggacgcttcgcacattcttgccaagatccatggaaagaaacagcattataaaaacgaggttcgcggttgcaatacatcttatagattccggcagcagttatttctccctctttaccggtaccataagaccagctagtattacgtttatctacattttccgagaatcccttttctgaataagattcatcctcaagaataggtaatccccttcttgtgaaaaatgcatcaaccaatccttgatagactccttgaccaccaccgccactgaattcacgtgtggaagctccataaaggaaaaaatcaaagtaaccgtttccttttgttaccgggaaagtaatttctcggtttccttcactccatttcttgatatggacattataggtagacatgaatggatcgttctcaccggtaggacctgtttcaacatacagtttgtatcctgctttttccgcttcatcaatacaaagcttgcaagcctcggctgcttttacccatttgttgggatcgtaagtcggattgaataccagttcccccgctttattacgataatctttgtaccattcattaccattaaccagagggctagcagcaaacaataacatacgagaacgaacagtcagtgccataatcttattgatacgaccatatttagaaggatcatcgtagatagcaggcagtgcatttgcggcctccaacatttgttgatcacaataatctactacttcatcaaaaggactttgtccaatcatcaaatcagacaaggtgaaatcactaggggtgatataatccggtttaaaaggaatagcaccatagttttcagccaactgccaccaagcataagcagttaggaacttaacttccatcttcatattatctatttcactctgtggcaaatcactatccggcaaagcataggcacgttgttgaaaaatatatccgtgacggatatattgcggcatcatacgccaaaaatcgccatcccatgtcgaattgacagtccattcaccaaagattttaggaatggtggttttaccatcccattgctcccagcgctttgaaggagtcaggtcatcagcaaacacttcgtaaccatctttccagatacgccatttatcaggctcatgaattgtgttgtacacaaaagccaaccattgatacaccttatctctattggaaaacaccatttcgatgtccagttccgtgtcaggttctttatcaagataatctgcacacgaagtatttgtcgtaagcagcgaagccgccataagacccgctaccatatattttgaaaaattgagatgtctcataaaattgtttttgaggtttagtttagaaattaatatcaataccaaacaaaatagaacggttcatcggatatttcaaaccattattagtaccaagttccggatcccacaatttgaaaggagagaaacataagaggttgttaccgctgacaaatacgcgcgcccccttagagtaaattttttccatccatttcttcgggaaagtatatccgatttctacagttttcaaacgtaagaaactcatatccttcttccaccaagtagaagcacgatagttgttcttgttaggaccatatgtaaggcgaggccaaaaagcatacggatcttgattatcatccgtccaacgatcatccagattttcagaataagcattcccctgcacagttgtaccactacctggcaagaagatggttgaattaccaatcacacgatgagcgtcggcagtaccttgaaagaagaaattaaaatctatgttcttataagctataacaccgccaaaaccgtaaacgatacgcggatcttccgttccgccaatataaccttcgtcttcttcagtaattttaccgtctccattcatatcaacatatttaatgtcacccggataaagtttgtcagcacccacctcttgttttggaataccgaatttcaatgaaccatcagactcaaaatcgtctgcagtgaacaaacgttcagcggtaagcccccaaagttcattcatagagcgccctgtctgtccgcgataagtaccaattttagaaggagcctcgtcatactcgtctacacgattcttggcaaaagtaaaattcccatagaaagatgtaaaccagtctttattaagttgcttgtgcaaattaatcgaaacctccataccgccattcgttacttttccatagttagcccaaggatttgtgataaaacctgtttgtgtaggaataatacgacgttgcataaagatattcttacgtttttcacggaaaacatctactgtaatatccaacgcgttccacaaaccaacttccagaccaagatttgatttagtagctgtttcccaagtcagatttgtcacaccaatctcgccttctgtaatacctttatcgtagttcttttgtcctgtagtcccccaagtatatccgctggcatctgtttttagtgtagtcaaataagcaaaacgacgaccaccaatattatcgttacctgcttgtcccatactagcacggaatttaatcttatcaaaagtgtttttcaaaggctccatccacggttcttcactcatcaaccaacctaatgctacggaaggaaagaaaccgaaacgatgacctttggcgaaattttccgaaccattataaccgaagttgaattcagctacataacggctatcgtatgtataagacaaacgtcctgcaaacccttgtttacgataatcctgaatagaaccgtcgtcataagcctgttgattataaagaagcaaagcatcaatatcgttctttccgaacttacggctataattcaagttaaactcaaaataaacattggtattaccatattcagtgccggtttcactacccattgattcatcgcccacatcatacgacgtatacaccaaattaccttctgcatcacgccctgtcgccggatgtacggtaggagtattgctggtacgcgacctcctgctactgttccaacggtcgaaactgaagatacctttagctttcaatcccggcgtaatctgtctcaagtcttgttctacagaaaataaagtctgaatcttggacgaggtagtgaagtcataccctccctgcgtcgcagtcctccacgggttagctctattcatttcacgaggaatggaaccgtcgctataacgtgccgggtgcacaaaaggtaaagtctcgaaagcttcggaaaaagcttggtctgtgctgcaacgttgtttcctgaaacgattcagaaaaccaccaatatttacacgcatcaaggtagttttggttacgttcatatcaatattcgaacgcatattgaactgattattgtccgtagaattatctaccggcaatgttttatcttgttgcagaatacccgactcattaaaatatgaagctacgatacagtaacgcaagaaatcagaaccaccacttacctccaaattacctttggttgtgtaagcataatcttttgtaattgcatcaatccagtttacgttcggataaagatcgggatcatatccgctacgggtacgatcaatacgcgtttgatcaaaaggtaatatcgctccatcctgtgcagccagttggttgagtaacgtcatataatccggtgcatccaaaaaatctgggaatttggtaggttgattaatagaatgttctacgtgtactcttacctggggtgcaccaatttgaccgtgtttcgttgtgatgacgattacaccattagcaccacgtacaccatacatggcactagccgacgcatctttcaaaatagaaaaactttcaatctcggctacatctacgttattaagatctcgtgcaataccatccaccaagatcaatggagaattactgcccgaaaaagaactaataccacgaatccagaagttagaatcatcataccccggttcaccactacgctgaatagcaattacaccacttaacttacccgctaagttgttacttaatgtacgacttgtaccaaattgcagttgctgtggttgaatcgtctcaatagaaccgatgatagacgctttcttctggctaccataaccggtaattacaacttcctccaactccgaagcgtcttcctccagaactacattgagtaacttcgatccatttaacgaaacagatttcttcttaaatccaatataagaaaactccaatgtagaatttttggccggaacggttatttgaaacaaaccgtcaacatctgtcactgcccccgaagggtttgcaacattagctacaacaatcgttactcccggcaatggattcttatccttatcagtaaccattcccgttacacgaactcctttctgctgttgcacttccaaagtactctctacggaagcttcccgcaaagatgcagccataccatcagttggcaaactccaaaccgggacagctagagaagcaaaaaagaatgttcccaaaatgctttgaattacatttttcatactttaatgtataattaaggttaatattaattttaagtttaacatataaataagatcttttgagtcctgcgttttacaggatatgagtatattcaaatattaaatcaaactaccttccagttcttaataaatgaggagcgatgcgcattggcatcggagtataagaaggcggtgtataaggagataaatttcctcctactccaaattcttctgctgctcccggttccattatacggagatcgataagcggcggaaccgtattatcatccttgatgaacaacatgccgtcgcccgtcccgtcatgtccaccactaatagtaggcactgcaccccatggattacgcatgacgaaaagcatcgtatcatccacaggcaaagacacggtataagcatgtgcagaaacagttttatacttaccgtcgacaggaacatcgcttttagtgaatcctcctaccaccagttttcctctcttcagtgaaaccgacacggcacgttgcagctcggcaggagttaatttttccggagcaaaagcaaaactggagccattaccggtgatgatagctgctgcatattccgaaccgataccgccaatgtccgacgtgtttctaaacgcttgaaaccacttgatgactgccttttcaagaactgtagaccatgtgggctgaccgctcttgccggaacttgcgcccaaacttccactcgtacccacgaacagattacttactccgacttcgatctgctgtcctttcggatcgtacagcttcaccgtaaatgtctggttgccattattcttaataatattcttgataaatcccggataaacgtaagacaaagaacccatcaccgcacacaaacagcagtcaccaatggaatgttggtttacatctgccggacaaggttcgccaaaaggataaagattggagacttggaaaccagcccaactcaatccggcaaaaggatccggttctttattcggatctttcaaccacagcaatttttcctgcgtaacggacaaatccgactcggcatgctgagtacccatcacattatccggactatacgtacttccggaagatttcgacatcaaatcatcaatgtctccaacgaaagcagatgctgccaatgacaactctgcgagttgagtagaacttgccccatgattactttgtatgctcaatctataatatctatattcttcttcattttctacagcatacgttttcgtctgttttcgttctgcgaaagtctgatctttctgagtgtccagtactacccatttttgattgtcagaagaaccggataatgtccacgatttcggatctgcttccggagaatcagctgccgatgtaagtgaataggattttactgagacactactgtttccattccaatttatattcacattactatgataagtaacgtactttgtgtctaaatcattatctactaactttccaacttccgacccaacaggtgcatccgaatattgagtccaaagagttccgccacaaggcatactggaattattggcatctaatgcccaataagtctgaaagaaagctcttccttttccttgttcatcatcatctgaacagctagcagcacaaaacgacaataataaaattgaaaatagaaatccactcttcataagaaaagaatcggtgttcatcttccaccgcaacgatttcgcgtgatgttttttcattctaaatacattcattttacttgtttattaaggttactaaatacatttgtattcttaactatgcatatatttttcttgttaacgaaagcaaaataagttctttttcacctattacatatactctggcgtgacaaaatgaagacaaaatttcgttgacaaagaagcgcacaacaagcacaataagagcacaaaataaaatcctcatattcaacacattaagcaccactaagcagaataagagaacaataagagaacacaagagaaaagtattaattcaaatctgtattctcttttcaaacccgaacaaaatggggtaaggtaccgactccactattaatagacgtaaaaagactagctataataataaacgacttgcctaagaatatataacttgccggcagatatttttccaaatacctgccgacgagaaaatcaattctgttttttttcccatacagctaaacgagcatacagttctacaagtgcaccctgatgtagaatctgccatttattgccaccgtcttctgtcggaatatctccacttaaaccactcaaatcctcattattaatcaatccattattatgatgtgctttgccaaaccaggcgtgtaacatcgtactatgtatatcttccaaatacaatgagttcttgtcaatggagtagagttcgaaaaatccacgacacataatagtattaaaccatgcgtgtccgggcgacaggactttaaaatcacgtttcaaaatatccgaatgaaactgtttaaaccacttattgtgacaagcttccgctatttgttttgctaaattcaaataagaattctcttgcgttattttataaagaagacaagccaactgcaaaggctgaccagaattataagaatacttattcttctctatgttacctacctgagtgggatcatcatctttaggagaagcgttatcataatacaaatgatcactaggatcatacatataagtctgcaaccagttaaaacactcttttgctttatccaaataaatttgtttgttagttaactgatataaaatacaactcaatacccctgtcggagctgtagaacaagtattcttcgacctactaggttcgttcaattctctccaatgtactccgccaccacaagtttcatcccacccatactgtgccaaataattccacacagcctcagcctgagtcaaataacgtttatctctagtaataatataccattccgccatatcaagtccaatccatacattatcatcataaaaacgctcgttgccagctgccggatacacactatatgcagtacgtccacgatctgctatccaaaaagcctgaataccactgaacatatcattgtccaaagactcatagtgccgttcctgccccgtaccaagagaagcttctctcattgccacaaacgcagacaatccactaccttgtccccatacaagtgcgtctccatcccaataaccgtcagccttaggataccatgtctgccaacacgtccgaggccccttgtgataataatactctataacctttgtcatcaaggtatgagcacaatcaaacattttcatttgtgcatattcaaaggttgccgcttcctgacttttactctccgaccgcaaaccattgactcccactaaagtgaccgctacctcatacgttccctctgaaggtacttgtagcaaataatttgctccgtttttgtatttgacatcattaccatttaataaaacaatgctccattcctgcgtctttccggtgtctatcctccgataagctatttctatctggagatctttcacataggttttcctcacaaaattcacaaccagctctttctccctatttgtattcaacacttccagttgctccaccggatcaattttttggagaaagttttcctcttctttactatctccactacacgactgcatggtagtcccaaccacaaatagaactatcaatataccaattatcttttccatatattttttcatttattatttcccaacgaggtggtagcctgtttacaatccgacttcaataccttctgtcagattaccactagccagtcgaataccttgtttagttatcaccttgacaattgccatccctttattctccagttctctttttcctgtttttccaaccagtttcaccatgactttgttaccattacgttctgctgtaaactgttgtaaactataatcacctttttggtatgaccagccgtctccagcatcccaatacatacttccggaagccttgccttgctcatccaaacagaccaaaagcgtcaaaggatccagtgaattttcagtggtattctgtattatcttgccggtaggaatgatagaaccaccacgaatctttaattttgcctgatatttaccatccttatccccgtctactagtgacaaatcctcccatattcctttaggaagcgccgtttttttagcaaatgaagggattaccaacaggtcatcaccaaccagaaatgctttttcttccgctcttaacgaaagatcttttggatcagcaaagaatatcggacgcatgataggcatacctgttgtggaagcctcatgcaaaagagtataataataaggtagcaaaatatatctgcgttccaaagcaatacgggaaacctcttctatttcttttccaaaagcccaaggctctttattgttggttccggcacaagcatgaccgcgagaaaaagggtaaaaagctcccagtgcaatccaatttccaaacaaatcggcatctgcatggaacaagaagccaccaatgtcagcaccactcataggttgtcccgacagtcccaatgttaacgacataggtacagacatctccatatgctcgcgactggaaccattgtcacctgtccatgttgcggcataacgctgccctcccaagaaattagaacgagtcagaataaaaggacgtttcttaggttgcgcggctaacattccttctcttgatgacttaaccattaagaacccgtaaacattatgatattgcaaatgagttccggcaggaattccatttccacctctatgcaaattatcttccggcatcgttccggtaggtgtattactcacttgcggttcgttcacatcgttccaaaccccatctacgccttgcgccataaagtctttataaagtccgccccaccactggcaaactttaggatctgtgaaatccggccatgccactttccccggccatgcatcaccgttatattcttttccatcggcagtttttacccaaacatcatttgctgttcccgaatcatagacagaataacctgtttcagctttagctcccggatcaatcatccataccgaatggaacccacgcagatgcaagtctcgatttacagcttttggatcaggaaaaccttgcgggttaaatgtgaatatacgataaccatccatataatcaatgtccatccaaattacatcacacggaatacgcttgtaacgaagcgtatcggctatttctattacacgactgtcaggcgtataagaaaaacggcattgctgatagcctaaagcccagcgcggaaccatcggcatagtaccggttagttcggataatcctcgaacaacagcctgcggtgattctctgtcaatgataaatacacgaaaaagctccccttcacttcttaattctattttctcatctgtactgcttaattcagctttccaagtagtatcaaacaaaataccaaaggcggttccatccttcctgactcccatcatccatggatgtgactgatacaaacgcgttccattatcaactccgtatgctccggaatcggtattccacagttttatggtttttccgtttcttaaaagagatccggtaacttctccgcctccgtagatactcgtaccttccggtatgattaatgatgcattcgctttaccgtcagtcagtgaaaaatcgggaaccagctcccacccggaagaaagtgccccctgttcgcgaggttctttttcaattgcaaaagaaggtactttcttggcatcaaagccatcaggtacaaatttggcaattccatttcctaccataacgctacgcgcgacatttaccttcctcgtagaggcattaattgacaaagacaatgttacgagcaaactaattgctacagttttaatgcagttttgtttcatgatttcttaattaatgattctgttgaatacttatccttcaatggctaagtacaaagcgaattaaacactttttcactcattaatcatcctctgaaatgacaaaatgctggcaaaatcacattggtcaaaagacacataacatgtacaatgggagcacattataaacaagacatttacaatgtgttacaatatattgtgtataatgagcgcacaatataaagtacaagaaaactacggattcttatgctgttctcgataatccttaggtgtcataccgaattttctagcaaattctttgtaaaaataggaacgacttgatatccccacatcagcaataacgtcctgaatagaaagatcttcctctcttaaaaggcgcgcagctttctccatccgatagtttttaatcagatcgctaggagcaatgggagatatttccttaaacttacgataaaactggcgcggactcattgccatacgatcggctatcaatgttgaacccaattcttcctcttcaagattctgttcaatcacttgtaaaagtttacggataaaatcagcctgttctgctgtagtacacactatttgccctgccaattcacccaaatcttccaaataaatttgtttggcttcccgcttaccataaatagctttatgaacatcttctttcagaaagagaatatcatagggtagtacaatataggaatcggaccatttaatcaattcgcgttgaataaccgaacttgctttccatgtcagcaaaggaataaaagctgttttcgataaagccgagcgattctttccaacatattccataaacgtactttcctcttccgcatacatagccatatcaactaaaaaaacagcaggaaccgaacgatgaatttcctcaaatgccacctgtacacttttcaccgaatgtatcaaatattcttcagaaagtaatcctgttatcaaccaaaccatttcttcacgatcttctaataaaagaatcgttttcttttcactcgattgattttcaattaatgtggcgggatcgaaaataagcatcaggctatgttgaccactgtcagattctacataacgaacaactgtatgaagttgctctaaagctgattgcacaaaacaaagcatcaactgaataccgaaaaaccgatcaatatcttctttattaaacacagaggaaggagttccggtcagttgttgttgtagttctttaagcacatcaaccgtaccagatattattaacgacatcttgccgttttcttcctgcacactaaccgtaattctgcctgacgatgttttctgacaaacaaactgataacaataataaagaatacaacgtaaagcatttttatagaccggaaaagtaaaattcgcaggaatcagagattgtaccaaagtaacatctactccttctgacttcaacgtgcgaagtacttccatagataactcctgtatacacatacgggcagacaaaacaaaggtagtaggataaaaatgcttcagtttctctgaataaagcgtctctggccggaaaagagcactcatcgctgtttcacgtattaactccacttgcttacgacgttgttcataagaggtgttttctgcacgtagctgatcgcaagcatggtaaatgagggtaaaactatccaataagtcacgattataactactactttccagcacctttttattattttccgtattgagcaaccgtttcagtatacgttcatgaaggatatatttacgaagtaaatgaaacaaataaaccacaaagagcactattaataaaatataaaggagataagcccatagcgactgataccacggtggaagaatatgtatgggaatggaaaagaatttatactccgtatcgaacacgtctttcttataacggactttaaaaatataatcacccgcaggcacatcagtatatgaagcctcattgatgctgctgaatgaagtccattggttatcatatccttccaggatgaatgaatattccacttctttcccggtcaaataatcaggtacggtaaaagaaagagagaaagaagtttccgctccttccaattgcagactttttccatcttccgtataataatcacctaaatttactgctgtccgcccaagccacaaccgacgtaacacaatatccggataaaactcaggggcagccgccactttacgatccagataaagcagtccatcaattcctccaaagaaaagactgcctgtataaggacactgataataggcatcatcactaaactctcctatttgcacaccggcactgtaataataatcatgcgacgagccatttttcggattatatttgatgagtccgcgattggtacccagccaaaggaagccattgccatcttcctgtataccatgtatcatatcattaagaagtccctgctccctaccgatataagtagcttctatcttctttccacaaaatgaaagacaaaccaaaccagaagttgttcctacatacattttaccatcttcagtgcggtacaaacttaatatatcgtctaccgacttgcgcagcttttctttcaaagagatgacttgatattcttccgttcgtttatcgaaacgaacaagtccttttccacgactacctaaccataagatagaatccccttccgccaacatgggataaaacatcataatctcccgttgctcatgaaaaaaatgataacgtttttgctgacgtacattaatagtccctcctttcttttcaagcaccattttataaaaaccatccaccgccgttacagcatataacacactatcattttcttcataaatatcatgtatctcaataacaggtcgaccggaagaatattctaccgaatgcacagcatcatctctgaatgaataataaaataatcccggatttcctgcccctatccagaagccatccatatagcgactttgggccagtttataaacgtgaaactcatgattccatttaatatatgatgacattacctgtttctctccaggagaataaaccatagccctcccaagaggatttcctactgcttcatgataatcaggcaaatgtaaaagcccatctccctttgttccaaaccataatcctccatattcatctgtcagtatcgaacgtacttgtctactcaaattaggtgacatacgattcaacatcaaattggtagcgatcgaatattttttggcgtacatcacagctccctgcccgtccgatgcaatccaaagcaacccttgacgcggttccctataaattccatagattcggatattacgattgacgatctcttcttcatactttttagaagtacgtaaacgaatcaatccattagcacgaaatccaatgataatatcttcataaaagggaacaatccctgttattactccatatttctgaacgagtgatgaaagattacgaatataaatcttggatttacgagagatatcatacatatataaatctctgtcacaatctacgaaacaaaaaataccattctgatagaaaatatcttcaattgctttcgaatggaacttgtttgttgagatagataatttcaccgacaaactatccgtatcaaacctattgagtgagtaattaagaatttgtcccgtactaggtggaaatacccaaagccccccatcatcggtcacaaatgcacgtcgttccatactatccactggtaaaacagaagtttgtacccggataaaacgttgatgatgcgtattataatagtaaattccgtctccggtaagtatccaagtgtttccctgattattagaatgaacataataatcacctgaaaaatcatagttggctaccacttgcctcgccttttgcgagaagcggtttactcccaaatgggtagaaatccataagcaactgttatctgcctgcgaaatggaatgaatcacgttattgctcaacgttttgctttctgaaaaatcagagcgaaacacttccatcgtctttccatcccaacagttcactccatcatacgtgccaaaccacatcagccccacattatcttgaaaaagacaaagcactgcactattggataagccttgttgataatctacttttgaaaagaaataagtatcattgtcagctatagcagccaatgatctcatcattataaataatgctatcagttttattttcatgtcgtacgtttatcaataagctgttcaaaacctgttaggcctcttgctgatactgttacggacattagtaacattactggcaacacttgtaccgtttgcatgtttttcaatttgttagttccttcctagtctcaacagaagtgtatacacaaaagaagcgcgagaccgctaaacttatatccaagtgcaggttctggactacctctgtgttgaatacaagcaaaaacagctcacgcccttgactgtatatcagcacctaggtgcaacatacaaaccaaagggagaacgttttgtttatttcctcaacacagctcgaattgtccagattcgcacttgagaaaaagcactaaacgcttccttataataaaaacgtcctaaaggacagtacaaatatactacaattttcctttaattatccttttcacatatcaaatctacatatataagccgtttatttatcattgattataagatctataaacctttgtatatcactaacctccttatactatatctattctaacgaagtagagaagtaagctatatagattagtttcctctcaatactgcttacttctcatgtaatctattaatagaaaagttgctcttgattaagtccaaactttctttttattaacagtaaagttgcttttcagtaagcgtctccgcgattctatatagtgtattaaaataaaaaggctaatgatcccactaactcgcaatgaattagttgccttaaattttattattttaggaatatccctactcattatttctttatctgtgtgtttatcgtttgggcaacgtcaccgaaaaatgaggattcggagtatgttgttcaaagatgatagccttcatcttttccacgatatccggatgttggagtgttatgtcatgatcctcatgaatatctgtttttagattatagaggaacggtgttccttttttcactaccattttccaatcatccatgcgtacggcaatctggtctgtttcatcaaactcccaatacagaaagtcatgtttcttttgcttatttttacccagcagtgtaggagcgaaagaaatcccatcgaaataatcgacttctttttccttattgcggtatttcttttcgtagtctttgataccgataacttcgcagaacgtcggcattaaatcataaaatgcacagatgtgatcgtttacttcgcctgcaggtatgtgtcccggccaacgggcgataaatggaatacgtattcctccttcgtgacattgacgtttcagtccgcgtagttttccgtctctgccgaagaaagtaggatcagctccgccttcctcgtgagggccgttgtcactggagaaaataaccaatgtgttttcgtccagtcctttttctttcagttttttcaaaacttcgcccacgtaatagtccaggcgggtaatcattccggcaaattgggcgtgtgtatgcgtgatggcgttgtatcgtgagccttcgcttcccttaaattctttatccgggttgaatttagctttgtattcattcaggatagaatcttccggctgaacgagttccgcatgaggtaaggtgtaagtcaatacgccgaaaaacggttgtttgccgtcttgctgatccagccactccaatgctttctggtgaatcatgtcggccgaatattgcggacgtttcaggtagtcgggaccatacatcggatattggatgttttcatccatcactacacgtaccactccggtgtcacccaacgctttactataacggttcaggaaattgggataataaagatgagcctgaaactgacagatataaccgtagtattcgtctatcccccgtttgtcgggagtggaacaggaaccttcgtaacctccggcccatttaccgaacatacctgtggtatagccgttatctttcattatctccggcaggattacgtggtcgggatcataagggtgttgccccactattgagtattctttattctgtccatattccacgatcggtgcatttttccagtactccttgttacctcgtacttcacaatggcctgaatgttgtcctgtcatgaatgaagctctggaaggggcgctgacgggacttcctgcgtatgcttgcgtaaaacgcattccttcaccggccatggcgtctatatgaggggtacggataaatggttgaccgtagcatcctaagtctccatatcccatatcgtcacaaaggatgaagaggatattgggctgggtattttttttctgtccgttggcagatagggtagataggagcagggcactgcctatcaacgggattgattgataattcatgatattgttgtcattaaaataaaagcgtttcagtgtttcatatctggaattatttcccgattaagtcctttccttcgcgtacgctttgaaggatactttgcagttctgccactttctccggcatattctttgcatagttggttacctctttcacttctttcatcttataaagctggggttctttagagtttccggtttctatcttcggtccccattgaatcattttcggtccgtcattcggttcgatgtatttccagtctttggtgcggacagaaagcgtgtgattggaagcctgctctattacccacgggcggtctgtcttttctttacccagccaacttcccagatagttgtaactatccggtgcggtattcttaggcatcgtagctccggtcagggaagcgagagaggcgagccagtccacttgtgaaaccaataagtctgaagtcattcctttttttactcctgcaggccagctgacgatggcaggaatacgggttcctccttcaaaggcactatatttgttgccccgtagtggtcccgcaggactatgaccgttgagtagttcttctgctttgtcatcgtatccgtcgtctactaccgggccgttgtcacttgaaagaataatgagtgtattttctcttaatcccagtttttcgagtgtattcaggatttcaccgacacaataatcgaactgtacgatagcatcgcctcttaatcccatcggattttttcctctgaaacggtcgtgaggaaagcggggcacatgtacgtcattggtggcaaagtagagaaagaaaggtttgttttggttttcctcgatgaattgaatggcgtgtgtggtaagtgaatcagcaatgttttcgtctttccagagcgcctttccaccgcctttcataaaaccgatgcgtgaaattccattaacgatcgacatgtcgtgaccgtgacttggcttgaggttataaagtaattcaggattactttttccggtaggttcaccctcgaagttcttttgataactgacttcgatgggagcactcggatcatagttggctactttcccgttttcgatgtatacacagggtacacggtcggctgtggctgccataatgtaatgatagtcgaaacctaaatcgcccagtgcgcacggtaacggagcattccagtcttgagtggcggtttgatctccgagtcccagatgccatttgcctactgcggcagtggtgtaaccgacacttttgaacatatctgccatggtgtattgttcgggacggataatcattccggcatttcctgccgctacatccgttccttctttgcgccatgcgtattctccggttagcatggagtagcgggaaggggtgctggtggcggctgttgcatgagcattggtgaaaaggattcccgattttgccagtcggttgacgttgggtgtctgtacgtttttagctccgtaacattccagatcgccgtagccgagatcgtcggcgtagataaatacaacgttgggtgtttttgactttgtcggtgtggtgttttccggtgctttattggcggctgttgcagcacaggcaacagaggatacaagggttagaatgaaaggttgtttcattggttttgggggttaagtgtgttattattagtagaaaaagatgtgcctgttctttgccggacacatctttttcatcgtctgtttaacttaattcaatgatttcttcattgcagttcgtcagtttttctattccttcgttggtcactacccaagagttctcgatacctacgggacctacacccggaataacgattttcggttcgagggcaaagaccatacccagttctaattgttgctttatgcggggagccagtaccggagcttcgttaatttcaagcccgatgccgtgaccgataaatttggcttgttgtcctgttcccataaatttgtcggcaaatccggctgctttgaccacttcgactgctgtgtcgtaaagcacttcacaggcaatacccggtctggcaatggaagcaattttttcttggatatccagacaaacctgatgggcggtgtaagcttcttcgggcagtttgccgatggagaatacacggctcatatcgttcatgtaaccgttgaagttgccacctaagtccaccataacgctttgtccctcttttaacgaagttttatttgctcctcccggcaaggcaggatcaagtccctgaccgcctaaggcaaaatcataaggagaggggtaaccggcattatctccggtcagtacgctacccatgaatatttccatactgcgtccgaatacccggaaaattccgaggcaaccttgcaggcgcatcaggcgttctatttcgatggaaaattcaatgtccgtcataccgggacgataaacaccaggaatctgctcataagcctttgcatgagcaatgccggagcggcggaacatttcaatttctacaggtgttttcacgctgcgtgcctggcgaatcaacggggtaccatttaccacttccgcttccgggaagagaccggccagacgacaatattccgtataaggaagttcgtcaccttctaacatcagtttggttggcatcggtaatccttgttctttcagcagatcaacaatttgttccggtttgcggatagagaatgagtgctctcctgtgatgttattaggacgtttaaaaaataatagtgcaggcgaatgaagggggaggtaaagatagccactgactacacagccatacgtgtaaattaaatttgcattacacgtgataagtgcggcgtcaatgccctgcgacaccatcagactgcgaattttgtcacggcgaaatttcaattcgggttgtagcattttttatttattacttgattattaattacaaaaccaataatggtaaattattagttgtgagttgtttatcgcatataacaaattcacaaactattatttaacctatcatgctacaaagataattaattccagcgaaaataatgttaatctcaaaaaaatagcgctacccgcgtcctgtcacaggagacgagcagcgcaaaccacaaatacaaatacaactaaacaaagtccttaaataacgccttgtcccatcattgcgtgagctactttcataaatccggcaatgttggcacccttcacataattaatgtatccgtcgggttccgtgccgtatttcacgcattgtgcatggatgccgtgcatgattgcatggagtttttcgtccacttcggcggcactccagctaaggtgcattgcgttttgagacatttccagaccggaagtggctacaccacctgcgttgaccgctttaccgggagcatacatcgtcttatgttcaatgaaaagatcgatagcttcaggggtacatcccatgttggaaatttctccgacgcaaagtacgtcattttttatgagattttgagcatcttctccatttaattcgttctgggtggcgcaaggaagtgcgatgtctgctttcacttcccacgggcgttttccttctacgaaggttgcgttcggatactgttcgacataaggagccacaatatcgttacccgaagaacgaagttcgagcatatagtcaattttttcaccactgataccatccggatcgtagatatatccgtccggaccggaaatcgtaatcacttttgcacccagttcggtagctttagtagctgctccccaggcaacgttgccgaaaccggagattgccactgtcttaccttttatatcgatcccttttgcctgaagcatctggttgacaaaatacagtcctccgaaaccagtagcttccggacgaatcaatgaaccgccgaattccaatcctttgccggtgaatgtaccggtaaattcacgagtcagttttttgtacataccgaacatatagcccacttcacgtcctcctacaccaatgtcaccggcaggcacatccatgtccggtccgagatgacgccacaactccagcataaatgcctggcagaaacgcatgatttcagcatcactcttaccgcgtggagagaaatcggaaccgcctttaccgccacccataggcagggtagtcagtgcattcttgaatgtttgttcgaaaccgaggaacttcaaaatggaaagattaacggatgcatggaaacggataccacctttatatgggcctatcgcattattgaattgtacacgatagccgagattggtctgtacctcgcctctatcgtctacccatgtcacacggaaagtgaagatacggtcaggttctaccaatctttctatgattttagctttttcaaattcaggatgttgattgtatatatcttcgatagaaagaagaacttccttcactgcctgaagatattcagattcaccgggatgcttagcctccaaagaggacatgattttctggatgttcatgatactatattttaaaaggttaattctgataaaatgtcaactaactcactgcaaatataggaaaatttttcagatgtgattgattttatgccattattttgattaaataatgataaaatgatagtagaaaaagcattaggtatcaagtattcagtgctaatacttaatacttgatacctgaatttaatactttgtactttttacttcttaaaatccggcttcatgtccaaattgtacatgatgaaaccgtaaatgtctgcctgttcttcaagtacttttgccatcggtttgcctgcaccgtgacctgctttgctgtcgatgcggattagtgtcgggtttgtaccgtcgttgtctgcttgcagcgtagcggcaaacttgaatgaatgggcgggaaccacacggtcgtcatggtcggcagtggtcactagtgttgccggatatttcgtgcccggtttcaggttgtgcaatggagaatagcctttgaggtattcaaacatttctttgctgtcttcgcttgttccgtaatcgcttgcccagttccaaccgatagtaaatttatgatagcgaagcatatccatcacgcctacctgcggaattgctacacggaacaggtccggacgctgtgtcatgcaggcacctaccagcagaccaccgttggagccacctacaatggcgattttgtctttattcgtatatttttcgttgataagatattcggcagcagagatgaagtcgtcgaatacattctgcttctgcatcttagttccggctacgtgccagtcttcaccgtattcgctgccaccacgcaggttgacttgtgcgtagataccgccattttcgaggaatgggatgcgcattgcactgaaacccgggttgaggctgatgccgaaaccaccgtatccgtagaggaatacaggatttttgccgtctttcttcagatctttcttataggtaaggaacatcgggacttttacaccgtctttgctggcaaagaatacttgttccgtcacaaaatcatccgagttgaactgtactttcggtgcacggtatagttcgtaggtgttctggtccatatcatatttgtaagtggcacccggaatggtgaatgaagtgaatccaaagaaacattctttatcgtctttgttgccgctaaagcctacggaaccgagtgacggcagttgaatctcctgaatttgtttgccgtcgaggccgtaaacgtatgcatgattcgaagcatctttgtcgtaagtaaggaacagtttgccaccgatcacttctgcgtttgaaagaacggcttccgattcgggaacgagttctttccagtcctccagtttcggacggttgatgtcggctaccatgatccggtttttcggtgcgccatagttagtataaatatacatctgatcgccgatcacttcaatcgggtagtattggtagtcgaggtcggtagtcagttggataaaaggagaattcggctttttcaggtcccttataaataagttgttgcctcttccggcaccggattctgtgaggaagagaatacgttcgtcttcgctggtgctggctgtatagaaacgtttcggataagccggattctgataaatcagtttatctttcgattgcggttcacctattttgtgataatagattttgtgcttttcgtttacgttggagaattcttttcctttggcgggagcatcgtaggcgctgtagtagaagccgtctccctgccaggcggcaccggtaaatttggcccattcgatgtgctcttccaataacttgccactttcagtgtccatgacaaatatttcagaccaatccgatccgctgcgtgagatactgtaagcggtatatttgccgtcgtttgagaagtaaagaccggtcagtgccactgtgccatcgtccgagagcttgttcgggtcgaggaaaacgcgaggctcgccgtccagtgaatcctgtacgtagaatacactctggttttgcaggccatcatttttactgaagtaatatttgccatgtttcttgattggcgcactgatcttctcgtaatcggccagtgtggtcaatcgtttcaacaagttttcccggaatggaatctgacttagatactcattcgttactttgttttgtgcttctacccaggcagtagtagctgcactggtgtcattttccagccatctgtaagggtcgggaacttgtgtaccgaagtacacgtctacggtgtctacctttgccgtctcggggtagactagctttttctgttggggagcgcatgacatcaccatgattccactcattaataaagttacttttttcatgtgaataaaaagtctttttgaataaacttaaagttacaaatctacaaaataataagagataaacaagtaaactttataaagaagatggtggaaaatgagatttaaagaattaactttgcaaaatgtgattctgcagatagacgatttgaaataagaaaggagaatgactttatgcttagtaaatataaattaaaccagctttacttcaaagatacgcaattcgctaacttgatgacaaggcggatttttaacgtgttattaatcgctaatccttacgatgctttcatgttggaggatgacgggcgcattgatgagaagattttcaatgaatacacttctttgtctctgcgctatccacctcgtttctcgcaggtatctacggaggaggaagcattgtcacagttggaaaatatgtcgttcgacctggtgatttgtatgccgagcacgggggataatgacagtttcgatatcggccgtcacatcaaagagaaatacgagcatattcctatcgtcatactgactccttttagccatggtattaccaaacggattatcaatgaagatttaagtgcgttcgaatatgtgttctgctggttgggtaataccgacctgttggtgtctatcattaagttgatagaggacaagatgaatctggaacacgatgtacaggaggtcggtgtgcagctgattcttttggtggaagatggcattcgtttctattcttccattttgccgaatctgtataagttcgtgttgaagcagagtcaggaattctctaccgaagccttgaatgcacaccagcgtacgctccgtatgcgcggacgtcctaaaatagtgttggcacgtacgtatcaggaggcgatggagatctatcataagtatcagaataatatattgggggtaatcactgacgtccgtttcccgaaagtggaacggggagagaaagacggtctggcaggtatcaagctgtgtgcggagatacgtaagaatgatccgtttgttcctttgattattcagtcttccgaatctgaaaattcgtcttatgcagtcaagtatggtgctagctttatcgataagaactccaagaagatggacgttgatttgcgccgtatcgtctccgataattttggttttggtgattttattttccgcaatccggataccggggaggagattgcccgcgtccggaatttgaaggagctgcaaaacattctttttgccgtacctgcggaatctttcttatatcatatcagcaggaatcacgtgtcgcgttggttttattcacgtgccatgttcccggtggctgaatttttgaaaccgataacctggaatagtcttcaggatgtggatgctcaccgtaaaatcatctttgaggcgattgtgaaatatcgtaagatgaagaaccagggagttgtggcggtctttaagcgcgatcgcttcgaccgttattctaactttgcccgtatcggggatggctctctcggaggaaaagggcgtggactggcatttattgataatatggtgaagcgtcatccggagtttgacgagtttgaaaatgcgcgtattgctattcctaaaacagtggtgctttgtacggatgtctttgatgagttcatggacaccaacaacttgtatcagattgcactgtcggatgcggatgatgctacgattttgaaatacttcctgaaggctaaattaccggaccggttgatagaggactttttcactttcttcgatgtcgtgaagtctccgattgccattcggtcttcttccttgttggaggattctcactatcaaccgtttgccggaatttacaacacttacatgattccttatctggacgaccgctatgaaatgttgcggatgctttccgatgccatcaaaggggtgtatgcttcggtttatttccgtgacagcaaagcgtatatgcaagctacgtcgaatgtaatcgatcaggagaaaatggctgttatcttacaggaagtagttggcaatcagtatggtgaccgttattatccttccatgtccggtgtggcacgctcgctcaattattatccgttggggaatgaaaaggcagaagagggaacggtgaatctggctttgggattaggaaaatatattgttgacggtggcatgacccttcgtttttctccttatcatcctaatcaggtgttacagaccagcgaaatggaaattgctctcaaggagactcaaacccgtttctatgcattggatttgaaaaatgccggacatgatttttctatcgacgatggttttaatttgctgaaacttcatgtcaaagaggcagaaagtgacggtgctctgcgttatattgcttctacctacgatccgtacgatcagatcattcgtgatggtttatatccgggaggacgtaaggtgattacttttgctaatatcctgcaacatgatgtttttccgttagctcgtattctgcagttagtattgaaatatggtgaacaggagatgcgccgtccggttgaaattgaatttgctgcaacgttaagtcgcgaacatgataaatccggaactttctatctattgcagattcgtcctatcgtagacagcaaagaaatgctggacgaagatttgaacgagattcctgatgagaatgtgattctccgttcgtataattcattgggacacggcattatgaatgaggtatatgatgtggtttatgtaaaaacggacaattatagtgcctccaataatcagacgattgcttgggagatagaaaagatcaatcaacagttcctgaacgaaggaaagaactatatattggttggtccgggacgctgggggagcagtgatgcatggcttggtattccggtgaagtggcctcatatttcagctgcccgtgtgattgtggaagccggtctgactaattaccgggtagatcccagtcaggggacacactttttccagaatctgacttctttcggggtagggtatttcacgatcaacgcctttatgaatgatggagtatataatcaggatttcctcaatgcgcaaccggcagtgcaggaaacgaactatctccgtcacgttcgctttgaaaagcctgtggtagtcaagatggacggcaaaaagaagttgggagtggtcttgatgccaggtgtcgataaataagctttattaacgttttaactattacataatgaagttctgtttttcatctgaaaggcagaacttttatgttatatctcttaaaaaatgttttatttttcatattctaggccttaattgtggtcttcttttcatattcggaaataaaactttctttagatactttattataaagaaataaaactgtatttttgcggttagtttacaagatagcacctgtatattaggtatttaagcttatctttgatttcagagagagggactccgtattatttaaaggcgtatttaattcggtatgaagggtattttgaagtttattttatttttagagattgtattgttgtgcagttgtgtaaacgatgaaaagcgttcgggtgcctttggcggaatgagcttgcatctatccgcaaattcttcggtgacagatgttacgacacgctcgagtgaggaagtactgccttccatacaagatttctctatttctgtgttgcaaggtgacaaagtgcaggcttcctgggataagttgagtgactatgatgaagacactacttttccggtaggaagttataccttgaaagctttctatggtgacattgagaaggaaggctttgattctccttattatgagggtactaccgattttaacatccgtggtggcgagactactcctgtggaaactacttgtaagttggccaatactaaaataagtattgaatacacggatgatttcaaacagtattttaagacttattcttctaccgtacaggcagagttgggaagtgaagtttctttttcgtccggagaaacacgtgctgcttatgtgaagccgggtagaatttcagtaaaactgactttcacgaaagtgaatggcggactaagtccgactactattgaagtggctaccattgaggaggcgttagctcaacatcattatcatttgcaaatgaatgtggacgctggtaaagccatgttgagcattgtttttgaccgtgtaacggaagtcagacccattactttggatatttcggataaagcattgaatattaaacctccttatttcacattgaccggatttgagaaaacaagtaatgatggtaatcagtgggacggtaatccgattgaatcgaatcagttatcggctttgttgacttctttgggcggttttacgaaatgtattcttagaactacttctcctaatttacccgattggccggaggaaggatttaatctggcggcacttactcctgaagatcaagcattgctggacaaatcaggtgtgaagttgattggctttggtattaatcaggatcagatgggtattattaattttactggtttgattcctaatctgaatatcacggataataatgatactcatttattctatttgagtgccactagtacttatggtaagcaaagtgaagattatgtgttgaatataacaacgcctaagaactttatgttgctgcctacggagcctgtgaagatgaagagtaaagaagtgacgattccggtgaaactgaaagaaggcaatccgcagaatattaagctctattatcgttattatggtgtgatgactttgattaacaatacggttatcactccgatagaaggaaaagaaggatattacaatataaaagcaagtggtattgatatgggagttgtagccaaagacttccaggctgaatataatggtttgaaatcagccatcgtttccgtagctgttattataccttcttatagtgttatcctcgaaccgtttgatgtgtggtcatacacggctgaaatgacgattatacctgaatatgccgaagatatgtctaatgtgatgagtgctattgaagcatatatttctttgaatggaagtacgtggacgaaagtggatgccaaagatttgaaactggatgtaaccactggaaaggctgtcatttcaggacttactccgggaactacttattatttcagaacgacttgtgatgatggtacgacttattcaattcctgttatgcaggcaacagagagtgtaatacagcttccggatttcacgcagggatggggtaagacaatctttagtggaactattaataaaggaggaaagtatactcatggtgcttttggaacttataaatttgatacaacagatttgactgtttttgatttagatggaaatggggcttgggttactgttaatcagaaaactgtaccaactagtggcaatctaaattcttggtatatggttccttctagcatcaaacaaaataatggtgttttaatgcgcaatgttgcatggaccatgacttcagcagatcctccagggaaaagtgctttgtttggaaatagcttaactgatcttacgcctcctacgcatggtcatcgttctgccggtaagcttttcttgggaagttatagttataaccattctactaatgtcgaaatctataatgaaggtatatccttcacttcccgtccgataaagctaaagggtacttatacttatgtagctaataacgatcagggcggtattgtaactgtaatagtagaaaaccgcgaaggaggacaaacattaaagctggccgaaggtagtgaagtcttaacagcgacgagttctcaaaaggacttcacggtggacttaacttataatacgatgtttgagaaaaaagcgactcatttaagagtgatgtttgcctcttcttccaatgcttcaaacactcaaagtgttgaagacagtaagattaaaacaacggataataagggtgaagctgtttctactggtagtgaattgtatatagataaaaatataatattagaatataagtaatgagtaatatgaaagcaataaaaaaactcgtttttatatgtttggcaagcatcttaggtttatgcagtgcttgtatgaatgataaccctgattttggaagggacgacgaaggaaccgggaatacaaatcaaggcgaaggacaggtaagacttgcgggaacaagtgtttctgtttctgtggatgtgctgtcacgtgcggacggtaaagcaatcaatacagatgattatatcattcggatttattcaactgataataatttattggtaaaggaatatacaagatatagagatatgccggagatcttgaccttgaatgtgggtaactataagattgaagcattatcacatgacgtaaaacctgctgaatgggaaaaacctttctataaaggaacccagacttttacaataaagaaagatgaggttacatcggttgatgtaattaaatgcttcttgcagaatataatggtgacagtcgatctcaatgatgatttgaagcagaaagtcggtggtgaccaatccattacaataaaagtcggtacaggtgaactgacttttaataataacgatattggaagtggacgtgccggattctttgaagctgccgaagtaagcaatatcattattgttcatttccagggaacggtagatggggaatggacagaagagcaaaccagtttcagcaatgtgaaaggtggagagcaccggaacattatgtttaatctggagataccttcagtgggtgacatgggattaagcgtaaagctggatgcggtatgtaagaaagtggatttgcttgcttgggctaatccgggagcagaagatatattgccggaagatccatctgtaaatcctggtacaagtgcaccgacaatcgtaggacaaggtttcaatataatggatgagatagaagtcgagaaagacgaaaccaaaactattattgttaatatcacggcagataatggcattcaaaatttgaaagtgaagattgattcggagactttgacgcctgaaattctgaagtcggtaggcttgtcttccgaatttgatttggcacatcctgcaaatgctgatttggagaaagcgttgaagagcttaggtttcccggtgggcagtgaagtgatcggagtgaaatatttggtgtttgatattacacagtttaccccgctactcggattgtatggacttgcttctcataattttattattaccgttgtcgatcaggcaaataatacgagaacagctactttagcattgaaatcaatagcaaagaaaacagaatgaaaaaactgatacatatattagtcatagctttcattgttggacttgtttgtgtctcctgccgtgaaagtgatctgacaaataatggagagggtgcattatctttaaagataggtgttcaacgtgaattacccactgtttctgccggaaaaacgagagctacgcttaccgatgaagaattgcttcagaagtgtaaagtgtatatccgtaacgcggagggcttggtgcgtaaattcgccactttggatgaaatgccggaacaaatactgttagttcccgacaattataaagcggaagttactgcgggtgattctgtagctgcatcttttaccgattcttatttcaaggggacgaaagagtttacaatttcaaaagggacggctatttcggaatcagtagtgtgtggcattcgcaatacagtagtcagtctggttctgtctgacgaattacaggaggcatttcctacttataaaattacggtgagtaaccgattgggaaccttggaatatacacaggataatatatcccagcttggatattttatgctgttggatgatgaaaaccaattaagatggaattttgttgggcaacttaacggcagtgaaacagaaataaccaaaagtggagttattaatttggtgcggaaagcaaccagatatgatttgacttttagtaattcttcctctgaagtgggtggtggcatgatttctgtaaatgtggttgagacagctttgacgacggatgagaaagtagatatactagcacgtcctgttattaagataatcgagaatgatcagatttatgagttggataatgcagtttatcgtgcgcaattcgacaaggaaacacctattgttgtgcggatggctgccagtgtgccttttactgaactgaaagtgacgagtgcggattttgcacggttgggaattacccatttttcttctttcgacttgatggaattgactgaagttcagataagagaactggataatcttggatttagtatccaatttaatgcggatatgacaaaggttcagtttgcatttaaggaaaacttgagagagataatgactaattcgattgacgacggtaataacacctatcgatttgacattgaagtaagggaccggaatggaaaagatagagcgaaaacgttgacggttatcgctacagatgctttggttgctaccgaggatattgctacacagaacgatatttggtcaacaaaagccactctgtatggtagtctggttgcttcagttacagaaatgaatttccgttaccgggcgcttggttccaatgactggatgtattcgaatcaggctgtgttgaataataaaatatttacgagtcaaataaccggacttgaacctggtataacctatgaatatcaggcaatggctggtactgttgcagcgaaagaaacaaaacaattcactacagaagctcctgcgcaattaccgaatgccgggtttgaagactggcatggaagttctcctctttatatttataagagtggtggagaaatgttctgggatagtggtaatacgggttctgctacattgaataagaatgtgacaacgtatgacgcaaccattaagcacagcgggaattattctgcaaaattacagtctcaatatgtggctctttttggaattggtgcttttgctgccggaaatgtatttgttgggaagttcctgaaaatagatggaacagacggtatcttacggtttggacgtcctttcacttcacgtccatcgaaattggtgctttattatagatatgtagctggtacggtggactattcaacattgagtgagttgccgaaaaacagtaaagacatgggctctatttatatagcattgggtgactggccacatcagacttttgaaggagaaacggatataccggtacttgttaagacaaagcctgctgacaggcagctttttgattcaaattcttcgaatgtgataggctatggagagtgtattcttaaagagtcgacggagggtgaaggattgattaaactggagatcccgattaactatcgctctaaccgtaaaccgactgatattattttagtgggtagtgcaagtagatatggagattattttaccggaagtacgggcagtactttgtggcttgatgatttggaattaatttatgaataagcaaagtatgaattactttatcaaaacttcattcctgataatcttgggaataattgttggaacgacgcaaacatgcgcgcaacaggagttcaaacggaatatagaaatgagaactttcattcctaagggacaatggattgtgggtagttcagtttcttattctcaatactcaaatgataactatcagtttctggtgatagagaatttgagtggagaagggtatgcttttaaagtgagtccggtattgtgttatgcttttaaggataatgtagctgcaggtggacgttttatgtatagccggacgtataccaagctaaataatatcagtgtaaatattgatgaagataccaactttgatattagtaacctgtatgaattgaagaactcttattcgggaattgctgtcttgagaaattatatcaatttaggtactagcaagcgttttgcattattcaatgaagtgcagttagagttgggaggttctgtttcaaaagtggtgaacggtaaaggggatgacctgacaggagtatatcagacttctttggatgcaagtgttggtttgagtccaggtttggttgcctttatcaataattatacggcagtggaagtaagcattggtgtgttgggactgaatgtcagtcgaacccatcaagtgacggaccggatttacgaaagcaaccgttcgtcgatgagtgccaattttaaaattaatcttttcagtataggactgggaatagctttttacctttaaaaaacaagacgaatgtataaacggttattggtaacagtactggtgtctgtattcgttttctctttgtggggaaagacggaaacggtttgtcaatcgttggaggtagaagattctgtccccgtttttcagaaggatacgctaccggtaaaagggagtttggacttcctgcgaatcaaacgtatcggacgctatgatcgtggaatcatgaattatcgtttcattcctaaagggaagtggatctctggtttcacaatgtcatactgggactacaatagtgcggataataaactgctgtttgcctactttgataattttgattgtgacgggcgtaaccttaatttttctgtgtatggcggctatgccgtgcgtgataatatggtgttgggattgaagttcggataccggaatatgcggggagccttgaataatatcacgctgaaaattgatgatgatgtcgatttctctttgaaagatttaaagttggaacaaaatttgtataacgtgtcgttctttcatcgctcttatgtaggtttggatgccggtaaacgatttggattgttcaatgagactgctttgacgttcaattttggaaagtctaaattcgaccgtggtgtagaagaaaatctggttaatactcaaacagatatatttgaggtgcaattgggaataaatccgggattggctgtttttatcatgcaaaatgtaagtattgaatgttcgctcggaatagccggcattcgttacaggcaggaaaaacagaaaaataatctgggagagacgggaaaacggatgacgggtggatctaactttagggtgaatcctttcaatattagtttaggattgacgatttgcttatgattttatgagacatagaaaaaaatacatattactgttcctgcttctggttgtatgtgccggcttggtattcttttatggaataaaaagtgagggacaggaagacaaacaggaggtattgtcatcagtagaggatactcatcaggtacctgaagctgctgtggactctgcctgccagataattggagaagtggaggaaaacgtgtctccagcagagaattctgtggaaaaggttgtgaagaagcctgaagaaagaacagtggagaaatctgaagaaagatcagtggggaagtttgtagataaaaagcaggcagataaaaggcagaaggttgcgtctaagagagaagcagtagctgttccgccggtttcttcaacggatataaaattggcttctgatgttgtcaatactcctttgaagttagaaggaactatttgtgaccttgtattgtcggagcgtcaacaggatagtaaaataacagctgcacttccggttcacgcggttgaaacggttaaaagagagttcgattggaaaagtgatacgttagagaccaagcgaggcattgatttattgagaatcaaaagggtagggcggtttgatcgtggcattgtgaattatcgctttatgcctaaaggaaaatggatgtttggtacggatttttcattttgggattataacagtgaggactctaaattattgtttacttacctcgataattttgattttgaagcacgtaccattaatgtggctccttttatcggttattttttcaaagataatcaggtagtgggtgtaaagctcggttataagcatacggacggtcatttaggcaatgttagttttaagattgatgatgacgtgaatttcactctcaaggaattgaagttgaaagaagagttgtataattgcacctttttccatagctcctatatcgggttggatccgggaaaacgtttcggattgttcaatgaaaccaatctgcgtttgggattcggacattcggagtttacaagaggttcgggcgagagtttgaagaataccaaaacgaatatatttgaggcacagttggggattaatcccggagtggctgtctttattatgcaaaatgtgagtgtggaatgtagtgtgggagtgataggcttgaaataccgtaaggaaagtcaggtgaataatcttggtgagaaaggttcccgtacgaacggtggagccaactttaaaataaatttgtttgatattaatttaggattaactataagtatgtaatcatgaaaagtaaaggcagaaatagacttttatccttaattatatgcatttgcattgcatttgctttttcatcatgcgtcaagaacgatttgccgtatcctgttgtcagattgtctattaccggctttgaggtgaatggacagattggtagtgcagtcattaataatgaagaacgtacagtaacagtagacttgctcgattctgtggatttgaagaaagtgattgtcactcgtttcgattattcggaagaggctaatacggatttgaaggtgaatacaacgattgatttgtcttctcctaaagaagtggtattgtctttgtatcaagattatcgatggaagattatagccaaccagaccgtcgaacgcgtatttagcgtcaagaatcaggtcggaggagctgtgattgacgaaaaagctcgacaagctatcgtttatgtcaataaaaatacgatgctcaacaaaataactgtgaaagatttgaagctggggccgatcagttctaccgtttcgcctgactttatcactttgaaggactttacacaagagcagaaagtaaatgtgacatttaaaggaaaaaccgaagagtggagtttgtacgcattcatcacggataaggttgtctttactaattcggcggatggctggactaatgtagcatggctttatggagaaggacaggaggatgtagtgaacggctttgaaatacgtgaagcttcatcagaagaatggacaagggtagatcaggatatcgttgtacagaatggagtaaatttctatgtttgtgttccgcatttgaaagcggacacggaatatgtgtgccgtgctttggtggatggtacagaggatcgtggtgaagagattacttttagaacgactgctgcgattcctttaacaggtggtacatttgataattggaatcagagtggtaaagtctggaacccgtggggaagtaatgaaactcctttctgggataccggaaatcaaggagctacaaccttaggtgacagtaactctgttcctaccgaagatatatggtcgggtaaaacaaccggtatggctgcgaagcttgagtctaagtttgtgggagtaggttctgccggaaaattagctgccggtaacctctttgtcggtaaatatgtggcaaccgacggaacaaatggtatcttgaactttgggcaatcgttctctgcttatcctactcatctgaaaggatattataagtaccagcccggagtcattgataactcttccattgaatataattatttaaaaggaaggacagatacctgctcgatctatattgccattggtgattgggatagtccgattgaaatacgcaccaaaccttctaaccggaaattgtttgataaaaatgataagcatgtgattgcttatgctgaatttacatcgggaactcctgttgccgtgtataaggaatttgacttgaaactggaatatagggctacgaacagaaaaccaacctatatcgtcctggtatgttctgcaagcaaatatggtgatttctttactggagcgtccggtagtgtgctttatgtggatgagtttagtctggaatacgattatgataactgattggctttatagcatataacgaagataatctgttagtgtccggtcatttacccattattcctataggccaatggactcatgccaacatatcgtttaaagtatttgccgaagaacgatgtgttggcaaaattgagtgaatcggaaatttcttgaatagagagtcttgtcgatttcaattgtgatttggcatccatgatgaccatgtgagaaataatttctatgcatgtgttcccagtaacctgttttactatagtacagaggtggttgtgtgtaatttttagtttctcagcataccatgctacattgcgtgtctgattataattttgcatcactagttgagtgaaattcttgtaaatcagctcattttttgatagattctctgttgtattttgcagccggtttttatacatggcggctattcctgcgtgtatgttattatatagatgtggagtaatacttttgcgtgttgtttcgtcgaaaaaggaataaagttttattaaaaaatgaagatattcttccaatagcttggcgccctccggtttcaatgagatgatcggtcttcccagtgtcacaaataaggtatcaattgctgcatggtttaaactagcctgttctatatatttggatgagaagccgccgaagtaaaggacaggctctccatttagactgtgtatctgaataatacttcccggcataattgttacgaaatcattagcgtgtactgtgaagtggttcagattgactgaagcttctatttctccatccatgcataatacgaaaatctccgattttaatcggcatggaaaattcgtgtacaagttgagtaaatccttattaatacctgtaccaatgagccattcttctggcaagtctattttaggtaattctttattcatcatgcattctctttatgcaaaggtaaccgattttgggaaatagaagtcttttttatttccccaaaaatatattggctggtgaaaaaatggtgttttataaaagaaatatggtgtttttcttcaaaatggaacagaaacaagaaaaatagaccttgtgttatattaaattagattgttattttgcaacgtgaaatttgggcattggtgcgatggtatatcgcgcgtttgctagtattaattaaaaagagaatttagaaatgaaaaagaaattattttattatctgtttgcagtattgtgtactgcgacattgtttacgtcttgtagtgatgatgacgatgaagtgaaatatccgatagatacagaattggctggaggctatgttggtaatctgtctgtgaatgtggatggtaatcaaatgggaactaccgaaaatcaaaaaatcacaatttcacagtctaataaggaaactaaccaaattgcattatcattgaagaattttacttttttggtaaatgttggtgatattgaagttgatccttgcactgtgaaagctatagatggtggttatgcttttgaaggtcaacagaatctagatttggtacagccacttggtaattgccctgttagtatttctggtactgtgaaaggtagcaatattaatattgaaataggtgtaaaggttggtgctcctttaaatcaaaatgtaaaggctacttttgttggtcgtaaattgacaggtagtgaaagttcggaggctaaaataataagttttattttggacgatgatattgtaacagaacaacctattattaatgaagaggaaggaatagtaacttttaaggttagcgatgctgctgttgatgacgatttgtctggaatgattcctactattgtggtatcatcgaaagctaaaataactccagcttcaggtgttgcgcaggatttctcgaatggcaaaaaggtggaatatactgtcactgctgaagatggtacaactaaaaaatattcagtttttatagctggatcttctgactactattcttttgagacctggaagtctttaaatgatggagcttttgaagaaccggatgggggatgggctacttctaacacaggtgtgtggtttataaagactgtttatcctgatgtatataatggtgactatcccgttgttaaaagtgaggatgctaaagatggtgctgttggagtgaaattgataacattggatactaaaggacaagcaggggctgattggggttttattaaaataccagctattcctaaagtgacttctggttctttatttttagggacatttgaaactgatattcagaatacattgaatagtactaagtttggtaatccatattattctaaacctatttctgtacaattctcttataaatatactccgggggcagtgtattatacatgccctgatccggtaaaagctgaagcagttactgaagatcctaatacaactgatgaatgtagtgtaactgctgttatttatgaagtgccatattgggagacggtggaccctgatgatgctaataataaagcttatgataaacgattgactggggcaaatttatatactaatacagatcaagttatagcaatggcaacattctctagtggtgtccaagaagattataaagatattacccttactttgaactatgagaaagattatgatcctactaaaaagtatcgatttgctattgtattttcttctagtaaaaatggtgataaatttagtggagcacctgggagtactttgatagtggacaatgtgaaagttgtagctgaaaaatagtagatatagaataaatataatttagttttatttcccttcactcttgttctttattatcatctgaagaataaatgagtggagggatttttgtagttgttgatagttattctagggtatgaagtttaaggtgtagatgaagaatgtaccgtaattaaattatatgttatgagtgttggtctattgagacgtccatttttcttagacactactcctgtatttattgatttagcccatacataaatgaaaaaactacgagaagaattctcgtagttttttattgacacaatatttggatcgtttaatataacaatatactaaaatgcatatccaaatcctatattcaaataaataggatacatggcaaatgagattgtatcaaaatcttttttgaaaatatcattcaacccccacgttaagtcggcgtatacatttagatgtttaaatgctctccattcaccgcctagttgtagtccccattggaattttcggagattttcggagaaatcataggtagctatgctttccccagagaaaactactcgtgagccagtttggtctggggtacgtaaatgaccgtcgtatacatgtccggagaatcccctttcgatgaggtatgatatgtatgggcctgcagacaatttccaacggttgcttatcttatagttagcaactaccggaattgtcagatatgaatttttaactttggtctttactcctcctgtccataatccttgtaattctccaccattagtattaataattttcataccgtaattttttacggtagcttcggtggtcatattcttattttcaagtcgtactcctacagtcatcccccatttgggatcgaaccacttagtcgcattaccttcaattgaaattgcgattcctggcgcataactatcaattttacggatttcttttggtagaggtaatggtgaagtcccaccaatactgaaaccggcctttattccatattcccatccatgtagataagaccagatgataccttgatttctttcttcctgtgcttgagctgtgaatatgcttacaaatagcagcacaactataatattgattgattgatattttttcattgtattagtttttttattctttacaaataagttctagctcatcaacgtatagagtgctaccgacagctcctctaaaataggcgccatctacgctggatgatagtacaatacctaatttatatttaccgttttgtagtttcgtatcgtcaatttctcgtccttttactgattcgaaatgtatagtaaactcattccattcatctgattcaacaatatcttcaggttctattcgtgctaataataccaatttatcagagttaaatacgttatcaccattaagcatgatagaattattttctgcctcatacataacagcataaatatcacatttgtccctttttccggtttgtggctgtccttctacagaataaacttccccagctttaaatttataatatcctttaagtgctatgggatgtttataaaattgaaaaccaaagttcgttgcttttctaggatttgtcagtgcattttctacttcaaatgtcccgataaataaatttccagcagcaatatacatttttaccattgcaccaaaatctccagtattacgagtttctagctttacagccttacctttaaaaccatttgcaacttgtactgttgggtaatctattctagaattagccatacccgttaatttaaaaccgggattaccgcttgaccattgtaatactttagatatttcttgtgaggttgcaggtgtaaattcgtaaaatgtatcgtattcactggaggttgtcagtaattcttcaaatttgaaaagggtaggtaattccgctaaaatcacattaacggtataaacaggctgccattgaccgtcttctgatgtaacagtgaatttacgggagtgcggttcttcgctgaaatcataggtagattcagtatctccagttattggagtatttactttaattgtagctccttgtggaagtgtaaattctaatttttgtttggaaaggtcggctcctttatttacatatacattgattactttagaatctgcatcgatatttgccaattgcacatcatcgcctgaacaaacatcaatggctgcttctgaatttaatgcttcatcctgtatgcaggaagatattgcacatgtaaagatgaaataggctattaaagtcttaattttcatttgattttcctttttagtttactaattcagtctcttttataaaacttggttgcaaagttaagtttcttttttgaaatgcagtacttcatcacttaagtaattcaataaaattagcgcctttttaaaattaatgttataaatgaattattcttttttaaatcccagcactgtttttataataaatctaacttccttgttataatcagcttgtactgttgcttcatttctttaggcaagaaagaaatatctatgaactctaaccatttctcggcaactttggtaaatttagaaaataggttgtctatgatctttttctctaaactgcaactattcatggcaacttcaaaatcagaacgcttgattttgcgtctttttccattaagtgtcaaagccaattcttcagtgtcctccggcatgaggagtgccgtagagatcatgtcatatcccggggtcagtgaataatagcctttacgctgactataaagtgaaaagtttttcagatgcatatccgcatttccggtcagccatgagaaaacgacttgttcccagaaatttattacgtcaagttttggcacagaggaatattgcataattatctttgctatcttttcataagagcctttatatttatactctgtgaggcgttccgagagctggcacatatcctccattggcaacttttcaccctttgcggttctatctatgcgtttagtgatataggccaattcgccatcggcaaaacgaatcaatgaatgagggacaacgttcactttagccaattcggcaagatgcatcgttaaatcctcaacttcaggcatgtatttaaattgttccgtttgcggtttgagaatataacgtccccataaaccaacgatagtaaagcgttgcggttggttgggggacgatgatatatcgagagacaattttgcttgcactcctgtaagtgtggtttgtgagcgtatgacttgttcggcaagttgcttaatatccgcttttgtataaggtaggagaggaactgttttgctcccaaatattttctttccgcattgagggtgaaaatcagtttctccctcgccaagttcctgataacaatataggcatctgctcatcattattctttatttaagatgggaatcacactaactgcaccgatgcaatctttgcaacaggcaagcagtagtgacatacggtcacgtcgatttatcttccaacttttttcagcaatatctaaaagccagccttcaggaataagaccgtcaaagaatgggaataatattagacttgtatatggcttttccgagattggcagtgtgaggctgatagattccgcatcgctggatttaatgtaggctgtatcatattgaaaggtatagccattttcatcttctgtaagcaatcctgccaactggtcttggttgtatatgagtgcttgtctcatagcttgttgaatttacttattggtacaacacccacttccgttccaaagagactaagcacttgatttactttatcaagacgcaaagtctgtttcccctgttcgagttcgcgtacaaaacgtaacccgactcctgatttttcggacagctctacttgggtcaagttatgttctttacgcatttgcttgacgtattctgataatgatttatcgttcatattatacccttttgggtacaaagataatgtaaattttctattttacaccctttagggtataaatttagttgtagatttatgaattataccttatggggtataagaaaacaggtactctttctttgggaagaaggagtacctgtagaggaaagtgatagcagattattctttcaaagcctcttgtaagtcaatacccagcgctttggcaactcctgttccatatgcaggatcggctttgtagcagttgcgcacatgacgttgtttgataaacaattcggagtctcccatggcacgggctgtattttcgaacaataattgttgttcttcagccggcatcaatcggaataagtcgcccggttggctataataatcgtcgtcatattcccgttcattgtagttgtaaacttcaccggtaactttaagaggcggttctttcatgtcaggagaatcctgccattcgccgtaactgttcggttcataccctttggtagcaccgtagttaccgtctacgcgcatagcaccgtcacgatgataggcgtggaaaggacaacgaggcttgttgaccgggatttgttcagcattcacccctagacgataacgttgtgcgtcgccataagagaataaacgaccttgtaacattttgtcgggagacagaccgataccgtctacaatattcatcgggttgaaagcagcttgttccacttcagcaaaataattttccgggttgcggttcagttcaaggacaccaacatcttgtagagggaaatctttgtgcggccatactttagtcaggtcaaacgggttgatacgatagttgtccgcttcttcctccgtcattaactgaatctggaataaccatttcggataatcgcccttttcgatgctctcgaagagatcacgttgatgagattcgcgatctttagcaactattgcttctgcttcctggtctgtcagattcttgataccctgcaaggtacgcagatggaatttaacccaaatacgttgattttctgcattgataaaactataagtatgactgccgaatccgtgcatgtggcgatatgaataaggaataccacgcggactcatagtgatagtaacttgatgtaatgcttccggtaaaagcgtccagaagtcccagttactgttcgggctacgcatattggttttcggatctcgtttgatggcatgattcagatccggaaatttaagcggatcacgtaagaagaatacaggagtgttgttacccaccaaatcccagttaccttcttccgtatagaatttcatagcaaaaccacggatgtcacgttctgcatcagcagctccacgttctccggctacggtggagaaacggacaaaacattctgtttgttttccgactttactgaaaatagcagcacgggtgtactttgtaatgtcatgggtgacagtaaacgtaccgtaagctcccgaacctttagcgtgcatacgtctttcaggaattacttcacgatcaaaatgggcaagcttctctataagccagggatcttgtaacattacaggtccgcgttgacctgcggtttgcgagttttgattgtcagcgataggacgaccgttcgctgcagtaagttttttcttttccataaatagattttttagtcggatacaagtataagcagactgtttccttttattctttcatccggggtttataatatataacaaagataggcttcttttgctcgcttgtcaaacagataatttctatctaaagatagagaataactatgaattgtgtgtgtattgtctgctatttatttttctacaaagattattgtgctgacacccgggtgtcgtacatctttttattgcataaaaaaactcccgcacttccttcacggaagacgggagcttttaaataaactatagcttatatatcttttgctgattatacgataccttgtgccatcattgctttagcaaccttcatgaatccggctacgttagcacccttcacatagtttacgtatccgtcagcttctgtaccgtactgaacgcaagcttcgtggatattcttcatgatactcttcagcttttcgtctacttcttcagcgctccagcttaatttgatagagttttgagtcatttcaagacctgatactgatacaccaccggcgttagcagctttacccggagcataaaggatttttgcatcctggaatactttgatagcttctggagtagaaggcatgttagctccttcagatacagcgatacaaccgtttgctaccaactgacgagcgtggtcaccgttcaattcattttgagtagcagaaggaagagcgatatcacatttttcaccccaaggtttagctccttctacatatttgcaaccatatttttctgcgtattcacggatacggccacggtacagattcttcagttccatgatataatccagtttttcgcggtcgataccgtccggatcgtagatataaccgtcagagtcagagcaagtaactactttaccacccagttcgattactttttcgattgtatattgagcaacgttaccagaaccagaaaccagacaaactttacctttcaagtcagttccttttctcttcaacatttccatcaggaagtagatgttaccgtaacctgtagcttccggacgaatcagtgaaccaccgaattcgcggcctttacctgtaaatgttccggtaaattcatgagccagttttttatacataccgaacatgaaacctacttcgcggccaccaacaccgatgtcaccagcaggaacgtcagtttcaggaccgatgtgacgccacagttccagcatgaatgcctgtacgaagcgcattacttcagcatttgactttccacgaggagagaagtcggaaccacctttaccaccacccattggcagagtagtcagtgagtttttgaatgtttgttcaaaggcaaggaacttcaagatagaaaggtttacagatgcgtggaaacggataccgcctttgtaagggccgatcgcgttgttgtgctgaacacggtaacccatattggtctgaatattacctttatcatccatccaagtcacgcggaactgatatactctatcaggaatacacaaacgttcgatcaagtttactttatcaaactccggatgtttgttgtattcttcttcaatagtagaaagtacttcttctactgcttgatgatactccggttcattgggaaatcttcttttcagatcgtctaatacctttgctgcattcataatcttttttttctttaattggttgatataaataaagtgctaatttgacaatttgctaatataccgtttgactatgtgcttttgtgctatatagcagatttgcacatctgcgtatgggtacatcggatatttattttcggttgcaaaagtaaagataaaaattgaactagcaaacattttataaagaaaaatgcgataaaacatcaaatttgatattttatcgcattaaaaataggaaaaaagatatttatttgttctttttgatcgacttatagacaggaataaatactaatgctgccgaaatgccaagcattaccaccgtcatcccgtcaattcgttcggcttttgtcagaactagatagcaaagcgccaaccaaagcaggctgatgcaaactatttgtgatttggataacggacgtttcatttacctcctcttttctttttgtcaacgatggcgtcgatcacggctacagctgtgatattgacaatgtcgcggacagagctttcgaaatcggtgaaatgaataggtttgttcaatcccatctggatagggccgatgaattccgtatccgggtccattgcctgcaacagtttgtaaccggcgtttgctgaactcaagttcgggaaaatcaatgtatttacatcttttcctttcaggcgggtaaacggatatttgatatcacgcaattcgcggttcatggcaaagtttacctgcatttcaccgtcaatagccagttccggatattcttcctgcatgtgggcaacagcttcgtgcactttcacagggctacctgcagtatcagcaccgaagttggagtatgacaacattgagataaccggcgtgtgattgaagaagcgaactgttttatcagacaatttagcgatgtcaatcaatgtttccgtatccgggtggcggttaatcagtgtgtctgccaggaagtaagtacctttcttggagttcaggatatgcattgttccgaagtgtttgaagcccggttggataccgattacttctttggccactttgatcgtattgctatatcttgtataaagtccggtgatgaaagcatccgcatctcctgtttccaccatcatcataccgaagtagttgcgttcgaacattttatcgttggcttcttcataagtaaagccttcgcgtgcacgtttttctgcaagaatgcgtgagtaacgttcgcggcgttccgattcgtccgggtgacggagattgacgatttcaataccttccaggctaagatccatttcttctgccagttttccgatagcctcgtcatttcctaataagataggatgacagataccttcggctttcgcttcaacggcagctttcagcatattcggatggataccttcggcaaatacgacacgttgcggtgaacggcgggctgtatcatacagctgacgggtcagtttggattcataacccatcaattcgcgcaggtgaacacagtaagcatcccagtctttaatttcagtgcgggccactccgctttccatagcagcttttgccactgcgcaggaaacttcggtgatgaggcgtggatctaccggtttcgggataaagtattccgcaccgaaagagaggttgttcacgtggtatgccgcattaactacatcgggtaccggctgttttgccagattagcgatagcgtgtacggctgcaatcttcatttcttcgttgatagctttagcgtgagtatccaaagcaccgcggaagatatacgggaaaccgattacattattaatctggttcggatagtcagaacgtccggtagccatcagtacgtcaggacgtgctgccatggcatcttcgtaagagatttccggtgtcgggttagccaatgcgaacacaatcggcatcggagccatgctgcgcaccatatcctggcttaacacatttcctttcgacaggccgaggaatacatctgcacctttgattgcttcttccagcgtgtgaatatccgtgcggtcggttgcaaaaaatcttttctgttcgttcagatccgtgcgcgccttgctgataacgcctttactatccagcatgacgatgttttcgagacgtgcacccagtgacacatacaatttagtacaagatacggcagatgcacctgcaccgttcacaacgatttttacatcttcgattttctttccggccacttgcagggcattcaccaaaccggcactggagataatagcagtaccgtgctgatcgtcgtgcatgacaggtatatccagttcttctttcaggcgacgttcgatttcaaaacattcgggagctttgatgtcttccaggttgatacctccgaaagtaggagcaatagcctttactgcagcaataaatttctctggatctttttcatccacttcgatgtcgaaaacgtcgatgcccgcgtaaattttgaaaagcagacctttaccttccattacaggtttaccgctcaatgcacctatatcacccagtccgagtacggctgtaccgttggaaataacggctaccagattacctttagccgtatatttatacgcatcttgcggattcttctcaatttcgagacaaggttctgctacaccgggagaatatgcgagtgataagtcggtttgtgtactgtaaggtttggtaggcactacctcaatcttaccgggtttgccctgtgaatgatagagcaaagcggcttctttcgttattttagccatggtatttatgaaatttgttaataagttatcatttgaccgcaaatgtaggaataaaagttcgaaattgtagctgttgattaataatttctattaattttatagcaaaatggctgaatttatgatatgatatgtcaaggatgtgtttttgtattctattcccttttaaatgctatgatattgatttattgaaattttaacaagtgctttggttgtcggctttagttatttcgctatttttgaatcgatatatgatttaaccttattttataatgattaccacccagcaacttcaattattgaaagaaggaaataaaaatgcttttgaggcattgtatcgtggatacaatgctcgcatttataattttgtcctttctatggtgagcaatgccggggtggcgaaagatatcacacaagatatttttctccatatctgggagaagcggcttaatatcgatctggaagggaattttgacggctatctttttaaaatatcccaaaacatggtatatcattatgtaagacgcgaactcctgcttcaaaattatgtagacaggcttgcgaatgagtcatctgacgaatccgtagagatagatgaagaactggattatttgtttttggaagaatatatcctgaaacttttagaagaactgcctccagcgcgccgggaagtttttatgctttattggaaatcagggttgaactatcgtgagatagccgaccagttgaatatctcggaaaagactgttgccacacaggtacaccgttctttggatttcttgcgtgacaaactgggaataattgccttttcagtctctctcttcttacatgatatctaatatagaagttttaataaaagttaatatctgaactatttcgatttctctgtagtccttttctgtctctcaagactagtataaatagaacaggaaaattatggagcaacacgattacatagtactattggaaaaattcttcaaaaaggaggcctcttctgaagaaagaaggatacttattgaatggattcgtaaacccggaattcgtaatgagtttaatctgctttgcgagcaaatgtggaaagaagcagccgtcgaaatcgataagacagtggaagaagaaatgtggaaccatctgcagaggaatctggatgagcccaagatactatctccgaagaaacggcgctggcaacctattatatataaggtggcagccactatcttattaccggtttgtttgggactggccacttactttggggtagaacacatgaataaggtgtcacaggaccctttcatggtggctgtcgattatggacagaaagcgaatctgactttgcccgatggaacgaaagtctggttaaattcggctactcatctttcttatgatgcggagtacaacaaatccgaccggaaaatctatttggacggagaagcctatttcgaagtggcgaaaaacaaagataaacgttttatcgtctgctgcaatgatctggagatagaagcgttgggaaccacctttgatgtgaaaggctattgtgacgatcattctgtcacaacactgctggcagaaggaagcgtcaaggtttctaataaaacggacgtaaccttgttgaaacccggggagaaggtagaataccataagaacaagcagacatttactaaatcgcccatctcggatatgcgtgaaatcgacttttggcggaacaatatgttgatttttaattcatcctctttagcggagatcgcgactacgctggagcggatgtacggagtgaaagtcgtgtttgactccgagaaactgaagaacgtgctattttccggaaccatccggaacagtagcttgcataatgtattttacattataagccttacttatcctttaacctatgagttagaaggagatacggtgagaataggaagtagtattaactaaaaaaggacaatttatggaagacacctcataataaaataaagagggtagaattatgtagcagcataattccaccccgaaatcaaatacggtttatacatgatagtaaaaaagaaattttccttatgcggataagggaaagggaatcctttttgcttcacgattttacaaagataataaaaagtctaattttcagacttatattttaaagaatttaaagctaattactaatgagaaaacaattacatatcatattcaggcttgttatgttcagttgtatcttgttgtttgtgtctcaagaggcaagtgcgcagatcactttctctgtgaagaatcagacgatacgccagacgatacgagtgattgaaaagaaggctgattacagctttttttatacggataagcttcccggattagatcaaaaaatttcattgacagtgagtaatgaaagtattgatgcggttttagaaaaagttttcaaaggatcatctattagttataaaatagaatcgggtaagcaagtggtgcttactctgaaaagtgaacagaacgccccccagaaaggcgataagaaaacaatcaccggtgttgtggccgaccggaggggagaacccttgattggtgtcacagtgagagtggagggagagaatattggaaccgctaccgatatagacggtcgtttctctttggaagctcctgtgggggcaaaaatcagtttctcctatatcggttatgtttcccaatctcatacggtcaataagcagaacatatacaatgtgtcattgagcgaagattcgcaggtactggaagaggtagtcgtagtgggatacggttttatgaaacggaaagatattacgactgcggtatctgtcgtttccacggcagatattgaagaacgtccgattatgacagctgcacaggctattcagggaaaggcagccggtattcaggttgtgcagccgtcgggtatgccgggttccggagtgacaatccgggtgagaggagccacttcggtacaggcatccaatgaaccgttgtatgtggtggacggtttgccgtcggatgacatttcgaatatcagtccgaatgatattgaaagcatgcaaattctgaaagatgcctcatcggcagctatttacggagcacgtgcggcaaacggagtagtgttgattacgactaaaagaggaaagatcggtgcaccacaagtgaaaatgagtgcttatgtgggtttctctaaattagggaaaaaaatagatgcgttgaatacagaacaatataaagacttgatgaaagacttgaaagcagtttcggatgttgccccaaatatccccgaaagtgaaacgcgctatgtggactggactgatttattcttcggtacgggtgtcaatcagaactatcagttgtctgtggcaaatggaaccgagaaactgcaatattttgtttccggaggttattccgacgaacagggtatcgtggaaaaagcacatttcaatcggtataatttccgtgcaaacctggatagtgagcagaccaaatggctaaagatggcactcaattttgcatattcgcatacaggcggacaatgggtgaacgaaagccgtagttctttgcgtgccggttccatcttatccgttgtgaatactcctccgtttatgcagaagcggaatccgtatgatccgaacgaatatgatgaacaggcttacggtgcacgtattctgaatccgctggctgccaatgccgcagacagtaacacgaatacagaccatataaatggctcactcggcttcacggttgacatactcaaaggactgaagtttaaaaccacttttggcattgaactgaccaatgaacattgggactactatctggacccgatttcaacttcggacggacggggtacaaaagggcgtgtggaagagagtttctcacgaaacttcgaatggctttttgaaaatttgctgacctatgattgttcattcaacaaacataacctttctattttgggaggggctacccagcagcgtgcacaatataacggttcgtggatggcaggtttcgacctggcagagtcttatcccgatattcattccatcagtgccgccaatcaactggataaggacgcttgcggttcttctgcttccgcatggacgctggcctcttttctgggtcgtgtagcctacaattacgacagccgttatttgctgacggttaacttccgtgcagacggttcttctcgttttgccccgggacatcgttggggtactttcccttctgtttctgcaggttggagaatttcaggcgaaaagttcatgcaacctttgcaagacattgttaccgacttgaaattacgtgccggatggggtatgaatggtaaccaaggcggttttggaaactacgcttacatggcttccatgagcgtcagtaaactgcccgtttcggagggaaacttatatccgggacttgccattaaacccggctcggcagccaataaagaactgacctgggaaaaaacaagccaatggaatctgggactcgacctgaccatgtttgattcccgcttatccttctcggttgatgcttactacaaaaagaccaccgatttactattgacagtcagcctgccggagaatgtggtgccgagcagtgtgacaagaaacgacggtgagatggtgaataaaggtatggagttcactctctcttcccagaattttaaaggtaactttcagtggaataccgatttcaatatatctttcaaccggaataagctgacgaagctcggtttgaataaagtttattattatgctgaaatgtacgaatccaaggagaaagccgtcatcctgaaagaaggtcttccgttaggcacattctttggttacatatcagaaggcgttgatccggaaaccggagatattatctatcgtgacttgaatggtaacggttttatcgatccggaagatcgcactactttgggaaatgcccagcccaagttcatttacggtatgacgaatacattttcgtatgccggtttcgacctgtctgtattcttgcagggaagtcagggcaataagatttttaatgcatcgcgtattgatatggaaggcatgacagactttagaaaccagtcggttcgtgtgttggatcgttggaaacgaccgggtatgattaccaatgtcccccgcgttggtaatacagagaataatcataactcctcccgttttgtagaagatggatcttacctgcgcctgaaaacagtcactttatcctataattttcctaagaaatggttgaataagatacatctgtccagattgcaggcttacgtcaccggacagaatctcttcacactgactaaatacaaaggatacgatcctgaagtaaatgcttttggcggagactccgttgctcaaggggtggactatggtacttatcctcaatcgagggcggtaatttttggtttgaatattgaattttaatagctgcgaaaatgaaaaacataataaagttagcgtatgtcgtactctgtacattagtcgtttcatgcagtagtttcctagatgagaaaccgcaatcggattttatgcaggaaggtaccggaacggaagatcaggagtctaaatatggaagtctggcagatgcacaggccgagttgcagggtgcgtatgagagttttaaagcagatatattccagtcggaaaattatactattggagatgtgcagtccgataattgttatatcggcggagatggtgtggccgaacaggagtttgatttgttgaaactgacctctaccaattataaagtagaactggtctggtcacagtattattcgatggcgggcactgcaaccagtgtgattgaaaatacgaagatgatggatcctacttctaccgtagcagaagaacgtaatcgtgttattgcagaagccaagttcttgcgggcatgggcgtattttgatattgtccgtttatggggtgatgccccgatggtgctggatttgattccgaccattacagccgaaaacctcgataaatggtatccggtgatgtatccggaacgttctgccacagataaaatatatgaccagatcctggacgacctgaatgaagaaaataccattcgttacctggtaagcaagaataaaggaattttccaggcaaccaagggagcagcctatgctttacgtgccaaagtgttagcaacgagaggggagaaatcaacacgcgactataccaaagtggttgaggcttgtgacaaagtaatagcagaaggctatacgctggtcagcaattttgacgagttgtggcaacccgataagaaattttcttcagaaagcatctttgaagtctattacacctccgatgcacccaactgggcttactgggtattgctgaaagaagatgacggatcagtaacctggcgacgttattgtacacctactcatgatctggttgctaaatttgacaaagagaaagatacccgttatgcatccagtattctttggaaatcagtgccttatgatacctattggccggcagacagttacccgttgtcttataagattcgcgagaagacttccaatatcattttgatgcggttggcagatatactgctgttgaaagccgaagcactggtagagttggaccgcaccccggaagccatccggattgtaaacagcattagagagcgtgccggttttgctccttcttctttagatgaaaatatggggcaggccagaggacgcctggcggtagagaacgaacgccaattagagttgtatatggaaggtcagcgctggttcgacctggtacgcaataatcgtttgctggaagtgatgcagaagcataaagacaaagacggcagattgctgtttgcaggtttgcaggcttttcggcagttgtggccgattcctcaaggagagaaagataagaacaccaatctgactcaaaatgaaggctattaatgaaaagaggaacgtaaaactttaaaagaaaaaatgatgaaacacaataatctgtttttatggctgctggggctgactgtttgttggctggcttcatgcagcgaagaagatggccgggtgacgtatccatattcgtgtcccgaaatatcggaactgcaattctcaactaccgatcagacacctgctgccgattctctttatttttctgtgaagattcacgatccgcagactcctttgtctacgctggaagtgaaattgatgacaggtgaaactttggtcagttcgcagtcgatccgtacgaaaggcactgatgtctcgattgttgaaaaagggatttatatcccgtttgaagccggacttgaagagaatcaggaagcgaaggtgattctgacagccattaatgtggaaggtagtgaagtcactcaaacatttgatttccatataacccgtccgcagattcccgaagtgctttatcttcactataacggtgaggtggtagaaatgaaccggagtgaggacaatccttacctgtaccttacggaagtttccgattcggaagagggttatccgatggagctatccggaaagatctcaaccacagtatcattggatgatgcaaaactgatttggggagctgccgaagcaagcaatacggcagtccttattgaagcgtcgggccctagctttgcttttgattaccgggattggtttgtcgaacaaatcactttcaatgtgatgacttttgaactgggagtagtcggctaccaaaagaacctgaaaattaaagaaaccgagttgatagccagtgagggatttttccgtgcacagattagctttacgcagggggaagagttcgaaatgagtggatttgaagatgtggaacacgcttacaatcgcgacttctttagctataatccgaataatggcaagtttaccttcttgcgcaaatcaggaacctgggagatctattattcttctaagtataattatatctgggtggcacggatgggtgatacggctcccacttgcttctggctggtaggacacggatttacatgcgcacccgtctggaatgaagcatataatagtggaggctggaatttggaagacatatcacagttaggatatattgtgccaatcggtgaacagaaataccagaccaccgtgtatttgagtaacactcatgaatgggaatccttcgaaattgaaatttacagcgatttgcaatggaataaagataaaggcatgctactgcaagagggttcattgtccggcgatacggatggaattgaactatctggttccaatggaataacgagtggcgacggtttcgttcccggctattatcgtctgactttcgacgcctcgcagggagtaggcaaagaaactttgcacatcgaacgattgagtgattaatacctaaaagaatgatatatagaaaaacaggaaagcctatgagaaatatgctatatataatatggggaagtctgtgcctcctgctggtcatttccggttgtaaatcgactgacggggcgaaagcccccgtgtcattgacttggaagatgggagctgtggaagtacagcccggttactatgagaattcatttgtcctgaagaacatctcagatgttcctttagaaaaggattggatcatctattattcgcagctgcctcgtgagattctgcaggaagagtctgctccggtcaaagtggaagtggtgaatgcgaacttcttccggatgtatccggcagaaaattttcaaccactggctccgggagattcgttgaccgtcaaattctgttgtaccaacggattgaaaaaaatgtcacatgctcccgaaggcacttactgggtgagtcagtcaggcagtaagcaaggtattcccttgcctgtcggactgaccatacagccgctgaaaggaatggagacagaagactggtatcccgcacctgataagatatatgcttcgaatttggcgttggagactacagcccagttgcagcaaactgatatttttccgtcagtgaaagaagcggtgccggctaccggcaaagagggttttgctatagaaaataaagtaaaactgactttccatcccgattttgccaacgaagctgaattactgaaagaaaagctggcaaccatccatggcctggaagttgtatccgaagcaccggtaacagttcatctggattatttgccggaacgggaaacagcagtgaacggcgaatattatcggattgatacgggaaacgggctgataaatatttcagcttccacttcacatggcattttcaatgggacgcaaaccttgctctccctgttgaaaggtcaggaaaagccgtttcgtttggaagctctctccatccgcgattatcccgacttgccgtatcgcgggcaaatgctcgatattgccaggaactttacgactgttgaacatctgaaaaagctggtagatgtaatatcttcttataaactgaacgtactgcatttccatttttcggatgatgaaggctggcgtctggagattcccggcttggaagaattgacctcggttggcgcacgccggggacataccacggatgaactggaatgtttatatccgggctacgatggcaactatgatccgtctgcagctacctccggcaacggatattacacccgtgaagaatttatcgatttattgcgttatgcagctcaaagacatgtgcgtgtgattccggagattgagtctccgggacatgcccgtgcggcaatcgtgtccatgaaagcgcgctatcataagtatgtgaatactgcccctgaaaaggccaacgaatatttattaagtgacgcacaggacacttcccgttatgtttccgcgcagtcttatacggataatgtcatgaatgtagcattgccttctacataccggtttatggaaaaagtgattcgtgagttgatagccatgtatgaggaagcggaggtacctttgactacgattcatttaggtggcgatgaagtacccgaaggagcctggatgggttctcctgtctgccggacgtttatggatgaaaacgggatgacaagtgcccacgaactgtctgaatactatattacgaagatggcagactatctgcaacaacatcatttgcaattcagcggctggcaggaagtagcgttgggacatccggaagcaaccgatcggcatttgaaccaacttgcagcaggagtgtattgctggaatacggttcctgaatgggaagcggatgaaataccttaccagatagccaacaaaggatatccggtgattctctgcaacgtgaacaatttttatctggatttggcctatgacgctcatcccgacgaaagaggtctctcgtgggcgggatatgttgacgagtccaaaggtttctccatgcttccatatagcatttatcgttcttcgcgtaccgatatggcaggcaatccggtcgatccggacatcgcaggaaagggaaaaacgactttgaccgcttccggaaaggaacatatccagggagtgcaggcacaattatttgctgaaaccatccgtgattttgaatgggtggaatattacaccttccccaaaatcctcggattggtggaacgcggttggaacgcttttcccgcctggagcactttaacaggagagaaagaacgtcaggctttcaataaagaactgggcctgttctactccaaagtgagtgagaaagaaatgcctcactgggcgtcccgaagtatcaatttccgtttacctcatcccggactttgcatcaaagaagggcaactccatgccagtacccctatccggggaggtgaaatacgctatacgaccgatggcacggaaccgacccttcgttcggaactttggaaagctcccgtagcctgtgatgcttccgttgtgaaagcgaaactgttttatttaaataaagagagtgtaacaagcactctcaaagtagattaatccacaaaagtagataagttatgaactatgataagataaaaagaaccggaatattattcttgttgggaataggtgcgatcacatcgttgtcgtgcaatgataatgataacgcgaactacccggagcgagtgcccacccgcctgtcggtgatgcctttgccggaaagagtcgattataaagaatcggttgtctctctcccgcagaatgtaacagtcagccagaacattccggcttccacgtcgcaactgttgaaatccaccctggaagagaaactttctctttccgtcagtgatgcctccaacgatcgtgcctttatccgtgtgaaacaggaatcggatttggcaaaagaggcttaccggctcaccgttaccaaagagggagcctgcgtttattattcaacggaaaccggacttctctggggaatccagacattgagacaagcgctcgaacaagcaaatttcttcacttccggaagtgctaaatatcttccgatggtcgatataaaagatgctcccaaatatgattggcgcggatttcatatcgatgtagtccgccacatgtttacggttgattatctgaaaaaggtgatagactgtttgtctttctacaagataaacaagcttcacttgcatctgacggacgatcagggttggcgcattgaagtgaaaaaatatccgttgctgacgcaggaaggcagctggcgcgactttgacgaatatgacaagagatgcgtagaactttcccaacaggattataactatgagatagatccccgtttcgtgagaaacggttctcaatatggtggtcattatacgcaggaagagatgaaaggtttggtaagttatgcgttggaaagagggatcgatattgtacccgaaattgacatgccaggtcatttctcggcggctatcaaagtctatcccgagttgtcgtgcacgggagaagccggatggggagaagaattctcttatcctatctgtccctcgcgtccggagaactatcagttcgtgcagtccatcattgatgagatggtcgagattttcccttcggaatatttccatatcggagcagatgaagtggagaaagataactgggaacagtgtgaagtttgtcagcgattgatgcagcaggaaggttatcagaaagtggatgaactgcaaaaccgttttgtgaagattatgacgaactatgtgaagggtaaaggcaagaaagtgatgggatgggacgatgcttttcttgaaaaagagccacaggatttgatttatacttattggcgagactggctgcccgatcagccgggaaagattacccagaaaggttatccgattatattcatggaatggtcccgtttctatttgagtgcaacgccttcagacgaaggattaagctctttgtataacttcgagttcgaaccccagtttcccggcatcgtgaagcaaaatgtattaggcttccaggcttgtgtatggacggagatgattcctaatgaacggaagtttggccagcacgtgtttccctctcttcaagcattttcggagttggcgtggggaagtagccgtaactggattgattttaccaatcgcctgaaatggcatgttaaatggttgaatgcgaatggattctatttcaccaaaccgggatttctttaatcccggtacactaagaacaatatgaaatcagaacgtttactttcattagatatactccggggaatcaccattgtcggaatgattttggtgaacaaccccggaacatgggaatccatttacgcacccttgcgacatgccgaatggaacggactgactccgactgatttggtcttcccgttcttcatgtttataatgggcgtttccatgagttttgccttatcccggttcgatcatcatttcagtcgcggttttatcatcaaactggtacggcgcacggtgatcttgtttttgttgggactttttctttcctggttctcgttggtgtgcacaggagtagaacaacctttctcgcacatacgtattctgggagtgttgcagcggttggcattggcttatttctttggttccttgctgattgtgggtgtccggcgtccggcaaatctggcatggatctccgggatcattctggcaggttattccatcttgctggctttgggacacggatttgaactttccgaacagaatattattgccgttacagatcgcacactattcggagaagcccatttgtatcgggagtggttgccggatggcgggcgtatctttttcgacccggaaggcctgttgagtaccttgccgtgcattgcgcaagtgattatcggttatttctgcggaaatattttgcgggagaagactgaaatccatcaccggctgttgcagatctccatactgggtattgctcttttgtttgcaggatggttgttgagttacggctgcccgttgaataagaaagtatggagtccgacttttgtgctggtgacttgtggttttgcttccttgttgcttgtgtttctcacctggctgattgatattcgtaaaaagcagaaatggggatatcctttccatgtttttggtacgaatccattgtttatttatatagtggccggtgtgttagctactttgctggaggtaattacagttggggagagtagcttgcaggagaagatttacacttccatttggagcgttcttcccgatgctcatctggcctctctgatttacggccttctgtttatcggattcaattatctgattgtatgggggctgtacaaaaagcaactatttataaagatatagaaggtaagtgactagttagaaaaaggtagagtttatgccggatagctacggcagtttgttttcgtagccggatggcataaactctattgattatcagttcaataaatatacaggtaaacagtcttcctatttttctttctccgacggcgtgtgtgttgtccgccagaacgtatttttcacctcccttgccacctctttccagcttggtatattttttagtgagcgtcgagccgggaaatcgtaaagcaataacaataggaagaggaaaatgcaggcataagccacccagccgtaaatctgcttgatgcttatctccatcatctgactgataaactcttccatatagtgacccagattgaacggactactgctgaaagctacatgatcgatggctgaaccgtaacgggccagattgtcgggaacataatacgccaatccctgtgcatagactgcggctcccactacgccgcctactaccatgtgcagcatattgaacacacttaatccctggaagaaatgctggaaagtcatgatttcctccagacacaccataaaagtagcactcaatatggcataagcgaagccccgacatacggtcggcaggtaaagctgtgaaatatggatgtcggtggataaagttaggtagaaaccgatcaggtaaccgatcaacccgataaagccgacaatgaccaggcgtacataattatactgcttgacgtgcatccaccaatacgaaaacacacaaccgcatacgataccgacaatggcaagccaatcgagttgggaactgaccagttcttcatatttcattacttcctcgtaaaagacttcctccagcacgtgctccgtggcgaggaacgcttccactaaagtgactaatcccaataaaggcaaaaaatggcggtacgtccacatctttggttcgagaaatgggtgtcgaatggtcatcatgcgccaaatacaaattcctaaagtgatgaaaatcacgatggtcagttggcggatgaccgggctgttccaccagtcgtaccagtctccgtagttgaagaggaaggcgatttccgctaataaggcagcccatagtatcccgcccagccagtcgataccaaacagaggaaatttgcgcatgaaccggaaatgcttcacacaagtgaactgtatcaataagacaatcagcatcagaccggcaacgaacaggttcatgtatgtccagtgataatgatacatcaaacgggtcgtaatcaggtcggatagctggatgcttcccaaaataacaatatgaagccagggaaagaaaacggtgaaatcccgtttaggagtcatccacagctgaatgtttgacatacactcgaaagttccctgtattttgcacataccttcgatgaagcagaccaaccacaatagagggagaaaggtgatatgcggtgctatcaggttgcagagtaatactcccagtgcggccgatgtaagcagggttttattggtaaaacgaaacttcatgcggaacagtaacggaaagtagatcgccataccggccaggttggcatacatgcacattaaaatatcctcccgcatcagtgacatgctgccgatcatctgattcaatgcacccaaatagacacctcccgaaagttggaaggtgacggctatgaaaagataaatccacggttgcattttccgcggcacgaagctgcggaacatcggcaaaacaaaaggaccgttcagaacaggagcactcataagaattaaagattagaaattaaaaattaaagcaattgataattaaaacaatgattaaaacgataaagggttaaagcggttaatatttcacttcacattccacgttaaaaccggcacgcatgcgtttcaaatcttctggtttgtttcctttcagactgatacgtacgggaatacgttgctccactttcacgaagtttccggtggcgttgtcttgcggaatcattgagaaggcggctcctgttgcatcggagatggattctactactcctttgaatgtgacgttcggcacggcgtctgcggttatttccacttctgcaccttctttgatattcggaagctgggtttcgcggtaattggcgattacccacaaatcactgctgtctacgatatcaaccatagtctgtcccggttgcaccagttgcccttccaggatttctttctttcctgtcgtgccgtcacacggagcaatgatgactgtataagagagattcagacgggcaagttccaacgcagcttctgccaggcggacacctgcttcattctgtcccaggcgatgagtctgctcacttttcactaaagaagtagacattttagcccgtgacacctgttcataacgggctttggcagcttcgtatgctgtatgtacgttgtcatattgctgtttcgtcactgcgtcttcctgcaacagtttctcaaaacggttcagttcacgtttggcattttccatctgtacacgtacttcttcaatacttgcgtcgctcacacttaaattgttttgcgtagtggcgataccgatggtagtggcctggcgtcctgcggtggcattcgccaaatctgcttctgcctgtgccacacggagacggaattccgcatcttcgatgataagaagcgtgtcgcctttgcgcacttgctgatactcgtcaaagtagattttcttgatgaatcccggtacacgggtattgatcggcgtgatatgttgtttcacctgtgcattatccgtatattcgatatttcccaagtggataaaccgggaacaaacataagtgacaccaccgataagtaaacagataattacaatgttgtatattatcttctgggtttttctagctatcataatctgttctattttaagagagatgagaatttgattctgttataagttggattctttttgataagtcattacttctctgtcagagagtgtgtgtgatatatttcattttataataactgtatatcaagttaatacgtgcattgaccagaccgaggtcggcacttagtttcatattgctggcatcgagcatatcggtgagcagggcaaggtcgtttttataacggttgctggttacgttatagttctggtcggcaagttccacgcttttctcctgtgtacgcaggtctgtgaaagaggtgagaaagttgacgtagttcgcctgtacaccgttttctatttgttcctgtgccagtgaatattcctcctgtgctctgcggacgttcagttttgcctggcgcactttcttgttgtttttaaataaagaagaaagattgtatttgataccgacccccacataccagtaattgaagttattgtcgagcaccgggacttcgatggtgataggaccatctaaatgttcaccggccacaagtgcaattttcggaagcagttccgagcgttccaatttcactttctgctcgttcattttcatagccagctgggcttgttgcagtcctacattgctttgactggccatcatttgccagtcgttttcggctaatgctgtcacttcctcgttcagcaaggtagaatcgggaacgatttctgttccggcaggcagatgtaaggtagttaccagttgatgattcattattttgcgggtatcctgcacctttgccagttgcagtttcagcgtctctttctgtagctcatagcgggtgatgtcattttttaaggccgttccctgtgtgcggcgtgattccatgttgcggatcacctgttccgtcaaatccagattcttctgtaacacttgcagctggttattcaacttgtataaatccaggtaatagccggtcaggagaaagcggatttcctgacggttcttctgccagtccaatgcagccatttgctgaccgagttcagccagagtaatactgctgttgatggctcctccggcgtaaatcacttgttgcgcttccaacgcaaagttattgccgaagtgtggcatagggatattctgcccgtttttgaagtcacggtcccatatatatccgtcgcccaggtaactaaatgagagtgaggcacctatgtccggcaaacgttgtgacttggcagccttcaaagcttcatcggctgcttcctttccggttttatacgtttgaatactctgactgttctcgtctgccagacggaacatttcgtcaatgcccaacactctcctgtcaagcgtctgggcaaacagtccctgactgcatagcacggcacatagcggcactatgagccatctttttttgctcataaagtgaaaagaaatttaattaatagtagaattttgaattttcttcaccacggaataatacagagtaacacagagttttttcttttgaaatatgtcagttgacacaagttaatgaagattatttgaacgctgtgtcctctggtgttctctgtagtgaaaataggagggttatcaaatctgcgctgctacaccccaaccgtgaaagtcatgcattttgttcttgtaacgaatggcgatttgataatatcttagtttcatcttgatacctatttttctatttttggtttgcaaaattatgaaaaaaaacaagtaagttgtaaccctatataggctcaaatataatgttttttaacgaatggcagctagcatatcaaataggagaaagaatagaaagaagtacaaccactcctgaagtaaagatgcgatataatatgtaccgtaaggtgaagctatacgactaaataagaaaaattgttctgaaaagctccttttttgttctgattaagcctataagtaaataaaagaaaacctatacctttgcagtcgaattttaatcaatagtttatgactgcaataataaataaggagaactcaaaggtatttttgctgattttgctcggtatgttgtcagcgttcggaccttttgtgacggatatgtatttgcctagtctgccagccatggcagactatttttctacccactcgtcgatggtgcaattgggacttaccaccagtatgataggtctggcattgggacaaatttttttcggaccattgagtgataaatacggcaggcgtccgttgttgctcgtctcgatgatactgttcatcgtgtctaccgtattctgtctttttgcaccggacatttattcgtttatcaccttgaggttgatacagggaatcggaggggcaggcggtattgtcatatcccgttcagtggctacggataagttttcggggaaggaactggccaagatgctggccgtgatcggcgcgattaatggagtggctcccgtggcagctccggtagtcggagggttggtgaccgggacgatcggatggaaagggatttttgtgatattgctgtttattggcgtactgctgtggataggctgcatccgttttaaagaatcacttcccgtagagaaacgctcgaagacgggaatcgtttctactttccgtaacttcggtgcaatcgttcataacccccgttacatgctctatgttctgcaactggcgtttgcacaaggcatcctctttgcttacatagcttcctcaccttttattgtgcaacaacattacggattttccccctttgcatttagtatctgcttcgcggtgaatgcggtagctatcggggtggcagcagctatctccgtgaaattccgccaacctgaaactgggacgctgaccggatgcatcggtatgttgtgcctgtccgtctgtgtgatgattgccttgtataacggatgcggcttctggacctatgaactgctgatgtttgcattacttttcacaatgggactgacctttacttcctccactaccttggcgatggatagcgaacgccgttacgccggagcagcttccgccctgttgggagcactctgttttgcttccggaggtattgtttctccgttggtcggcttgggaaatatccttgtatctaccggagttacatttgtggtctgcgccatctgttccctgctttgtgcactatgggcgatgaggaaagtaccgatgaaagtagcaatgtgccggattttccgttaaagtgagattgtttcaaaaataaaagtcatgaggaagttaaagcttaaactccctcatgacttttataatttactaccagcataattataattactaccagtataaacagactgaaataaaactacagttttatctcttccgtgaatatctccccgaaacgattcttaaccaccaccttgacagattttgcatctttggaaggctgtgcacggaaaagatgacgtgtgcgataacccgttttctttccctttaccatattgatataatcctgatcctcatcgtcaaaagcctgcatagcacctttcaacactccatcctcgtaccagtttaccgtatacgtccagtcccaatcccagatattggctaccacatagtctttctggctttcaaactctcccggttggtaaagccggaactgatagtccggcgaacaccctgttgccttgtaacgccatttcacatcatcacctttcacttgtaccaccagataaccgtttggtgctccgcaacgattcacgtgtcctgcccaccatgcgccgcaggccgctccgatattatgttcgtaaatggtaggggcgggcaactgattttcataaaagtgcgtgtgtccggagaaaatatgtacttggtaaggcctcaacagttggaaaagcgcattggcgttgcgcgcatttccccccgcagctaccgtgttattagctactggagcgtgaacgttcaggaacacgatatttcctttaggcacataacttaaatcctttctcaaccagtccaaatcttccggcgtgaagcgttccgtgtatttcttgttgccgtcgtaatcaatatccttcattgctatcacatgaactttaccgatattgaatgaatagttggccgggccgaatgactgataataattctgttccccataaccatccgccggatgatccgtctgcgttatagatttgtagagcaggttgaagtcgtggtttcccatcagttggaacatcgtcattcctaagttggacaccgcttgacggtaaggagcgtacaggttcatggcatcccacaccagatcccccagtcccatgccgacgatttcgaagttctttagtgagtcggcagtctgtttcaggtcgggcactgtttccgtgcggaagcggtccagttgcttttcgtttctcacttgcgggtcggaaaggacgatgtagacaaattcatccaccggtttctgccgtttagtcaatacgaagtcacattggttctcgcttttcccggcatccagatattgatagaaaccatcggctaccccctctttggaaggaagctcatacgctgccggagtagagatgtaaaccattggataacgtgtcggatcagtgttcagaacataatttccttctgcatcagtcgtattgaaatgtgccccgtctgtcaccactacaccgctgatgggtttacctgtattatctttcacactacctttcaccaccgtctgaccaaaggcggcaatagcgttcagctggaaaagcaaaaccgctgcaaacagcgtttttctaaaattgatctttttcattgcttataactttcttaaagtaacctgattgaataatgcgataatttcttccggttcatctgccgacttgagagcctcctcaaaagacttgctgttatcatcgaaacacatcacattggcgcaatccagaatatgacccatgttgaatgtagcaacttcccggctcacctcttctttcttcaatgccttcttataatatttattcaccttattgaccgccttgtaaatagaaggcttcaaaatttcgaccgaagaatccgtaaatccgattgttacatcatactcatgcgtataattctggatgaaagtattccattttccggtaatgtcactccccagataatgttccgcttcaaacactggtttggtagtcgggatttctccatacacgtcgaatataaacgccgctttcggctttttgcctacgggagtagcttctttttcgtttttggaaacatggtcttttccggagatattctcgttcatggcgagctctcctttttgcgctgttgctgccatcgttataactaacacaacagccatactgattattcttttcatattcattgaattttaaagattgattgaaatgataattattgccgcaatcttggtgaccgacacattcatttattgttgccacatcagtcggatatggaagtcatcgcctcccatgttcgctttagccgcctgataatttttcaggttagtacgctgcagagcagatggatatttaaagcgtttcggcattttgttattagcatttgcgatgccgggccccacaggtaacacaggaaaaccggtacggttatattcaaaccactgctgataatcgcagaagaacagtgcgacaaacttctggttcatgattcgttccagcgtatcatcataagcagcttccggattttcaaaataatggtcaggcattttctgtccccactgttcgatagccgcctgcactcccttctgataagcctctttggcagcgctacttcctccgtcgatcactccttttttcagtaattccgctttgatgaattccacttcggcataaggcatcatggcaagtttcataggtgccttcgccatttcctgattcagtcccgaagcagtgattgaaggcaacgtctgataaccgctgggcaaacccacataatctttagtctggtcggggagagtgacctgtgttgcatacatctgcagacggggatcgttccaacctttcagcagattaacaaagaactctgaaatctgaacataagaagtgaaatcctgtggacgggtgagcggagcttcctccggataagttccgctgatggcaagcagggcagcatcatcgttcgattcgaataccggataagtggcgggatcggtcagcatggtacgcagctcctgtttcgcgttgaattccggcacgtcgatcacccggagcagtgcacgcagacggagcgagttgcagaacttcttccatttcaaaataccggttgcatcccctttggacgtcttgtacaacatttcgcccgattggttgtagatcaacccgttagctttgtcgaacaactcgttagctgttttcaggttgtcgataatctgttggtacacctgctgctgggtgtcgaacttcggtgcaagtattccctcgtcggcggagcaggcttcgctcatcggaatatcaccgaaggcatccgtcagaatctggtatagccaacattgcaaagtcagcgatatagcatcgtagttgggttgtttggaggcttccggcaattttccggtgaggcgcatcatctctttggcgttgttgatccatttataataagtagtccatgtgccgtctccttcgctgtccgtcatataccaccatcccacaccgttggtgctgctggtagatacggcgcattgcatcaggtcgtaggtatagctgttgtagcgtttccagttgtagaccgatgtttcgtataaaatcgggttgagcagcgtgccgggattcacctcatccatgcgggtggggtctgtattgagttcgtcgaagctggtgcaggaagtcgtgcagagagctccgcacaaagtcattccccatactatatttttgaaaagtttattggttttcataagtcagtgtttaaaaagatacgttaatattcagtccgaaagtacgtgccgtaggcagtgagcccgtctccacaccggtcaccatcgaacttccgttgagggcggcagattcggggtcgaacagaggatagtcggtgatacagaacaggttgcgtgcgtagagtgccaccgatgctttgctgaacggtgttttcttcagtgtgctgttcggcaatttgtactccagtctcatttcgcgcaacttgaggaatgaagtgtcgaacgtgttagtttccacattggccatccggtaatattccttataataactttccacggtcaccactttggtgtttggcgagtaagttccgtcatcgttcttcactgttcccggagcaatcatgtacatcccgtcttgtggtgaaagtccggcggcagcgatgcgcgggtcgtctttcgacatataaaattccgttcccggcagacgtccgttcagggtatgttgcagttttccctgttccgtcattttgtggtgcgagtgcgagtacattttacctcccacctgtccgtcgagcaggacgctaagcgtgaagttcttataagaaaattcgttatacagtccggctttccatttcggataggccgtgccgacgtattcgatctctcccgaacgttcgggcaatccgttgtcgttgatgaccacatttccttccgggtcgcgtaccagtttatatccccagagatcgcccgtagttccacccacacgtccgatgatagacacactaccgatactgctgattaactggttctcatccgccccttccgccagtgagagaatccggttctcgttcttagaccaggtgaaagtagcattccatcggaaatccctgctgactaccggagtaacgtccaactggatttcgtaaccgcggttgcggacgcatcccgaattgatggtagctttgctgtaacctgtggtcgggtccatcggagcatccagaatctggtttttggtgcggttataatagaatgtgaaatcgagtccgatgcggttgtgaaacatacggaagtcgaatcccgtttcgtaattggtcgaaatctccggtttgaaatcctgattatagagcgtagaagatacgatggccgagccggggaaatcgcttgtgccataatagggcgatgtcttgtaagggtctgtgtcattgcccacctgtgccagcgaacctctcactttcaacagactgatctgttccggcaacgtgaaccactcgttcatcactgcactgacgctgaccgacggatagaagaaagaacggttacttttcggcagggtagacgaccagtcattgcgcccggtgacatcgagaaacagtttatccttatacgagaaattggccgtgaaataaagactgttcaacgctttctttttgataaccgtctgcacgttcgggttggaaacaccgtttgccagtttgtatactcccggcgtaatcaatcctaccaccgaggcagccaacatatcgtagctttgttgcatcatgtttccacctgccgaagcgttgacacgcaatccgttggcgaatgaatcatggtaagtaaataaagcatcgctgtttaattcataatcgaacacattctgcttcttgaaaaacccgtttccgaaaaccacgtcactgataggacgatgctgttcgcgttggtcggctgacaactggataccggaccggatcatgaaatcgaatttactgttgatgcgcagattggcagaaatggatgatacattactgtgtttctccgaaggattttcagattcgtatagaatgacatacgggtttccgataaaggaactgtacggttggagctgtttcacattttcctgtccggtacgccacatcggacgcaaccagtcgaggttgacattcggattctggaagataaggaagtaggagatagagttactgttatatcccagtgcaggcgtgttgttgagcttgcggtacgtataactcgacttgaaattaatgcgcagtgccctcgaaatctgctgttgggcggaaaccatggcggtgatacgctggaaacctgtattggggagaatccattcgttcttagtgtgggtgatggacgcccgtacgctgccccggtcggattttccggtcaaggctaccgagttggtcagggtgtatcctgtctggaacaaatctttgcggttgtttttgtacgctacccaaggggtggcaacagaagcgcgtccctgcgttacggggtcatattggtagaacaacctgttggcgtcgaaacgtgctccgtaagcgctactggttccgctggtgcttgcgtaactgccgtcttccgctttcccgtaagagtaatagggctggccttcgtagatagaacctgccggaccgatattactcggcaatccctgtccgaattcatactggtaatcgggccatctcatcacatcgtcaatactgaagttaccgctgtaagacacaccgatacctttgggtgcacccgctcccgatttggtagtcaccataatcacgccattggctgcacgcgtaccgtacaaggctgtcgcactggccccttttaatacttggatgctttcgatatcatccggattgatgtcggagaatccgttaccatagtccacggaaagttcgctgtttgaacctgcaccgtaggcaacacccggattggtcatcggactactcatcggtacaccgtccactaccaccaatgcgtcgtttccgttctggttcagcgagacgtccccccgcagcgagatacggctcgaattaagcggaccaccggaagagataacactcaatccggctaccttgccgttcagtgccgtcgaccagttggtgggcagggcactcgtaatcatatcccctttcacggtttccgtggcatatcccaatcctttttcttcacgtttgatccccagggcagtcaccaccacatcattcagttgttgcgactcttccgccagttttacgttcatcgtattgcctgcatagttcttctgtagcgttttatatcccacataactgaatacaagcaaatccttttgagtcaatgttttcttagtcttcagggagtagtttccgtcgatgtcggtcaccgtgccgtctgtcgagtttttcacagctacggtagccccgattaacggttccccaccttcactcgttatttttcctttcactgttgtctgtgcgtatgcagagccacagcacaagagcccaattgacagagaaagcagccatttgtttcttttcataatcttttaccttgcttcttttaatttattaaatgcaataaagttattcacacccgtgtttttgtttcacggtgcaaaggaatgcaaggcagattaagatagtattacagatctgttaacaatctgtgttgtgcgataaatacaaattaataaaataaatggaggcacggattacacggttttagttaataaaagaaccgcgtaatccgtgcctaataatctaataataaaagattattttacttgattagatagaatacttactctgatactctttcggcgacatcccctcgtgccgtttgaagtaccttcctaaatacgactgatcgggaaaaccaagtcggtcggctatttcctgaatcgtcagtccggtggattgaagcaacacttttatctccaggatggcaaagtcgtcgataatctttttggcagcctcgcccgtcacgcttttgcagatacctgtcaggtatttggtggagatacacagtttgctggcgtagaaagtcacttcccgttgtgagatacagttttcatgtaccagtgcgatgaaattcttaaagatttcatcctgccggcttcctccttcgatttcctgtcggtcgaagtagcggtaacacttatcataaatatccagcataaacgactggagatgatttttggcgatctggttgcggaaacggttttcacgatcgttgtatatagctgttgtggcacgcattaacccgttgattgctcctgtgctttcatccttgagtgtatagcacggtttttctttgatgaaccggaagaagatcggctcgaaacggaggcaggcttcgcgaaacatttctttgggaaatccgaagaaagaagctgtgaaatcgctgctgttgccattgatgcggataatcgttcccggcaagagcacgatttgagtgttttctactatttcatagtctttcaggtcgattgtgacgtgtgcccatccgcttctgcaaaaatagatggcacccccttccagtttccacaggcgttgcataattggagacaggttttcgtccattccggcaacgaacggttcatgaagtatggctaggctagagttttttgattccattgttgttcttattttgggtacaaaaataggactttttcactaaatatcggttttaatgttcctaaaatgaacaaaactgaagatactaagtccagtttcctatgaagaaaacagtctacctttgccgcgttcaaaaatagttaaataggtaacagaaaatgagtaaaaaggtatgtaaagtgaagcaagggctattgttgctctgctgtatggtagctgctacgggctgtaaacaagctcctccggcacaaatggaaacagaatacgaagtgatgaccgtttctccggccgaccggatgatttcaagcgcctactcggcgaccatccgcggacgtcaggatattgatatttacccccaggtaagtggtacgctgactaaagtctgtgtaacggaagggcagcgtgtaaagaacggacagacattgttcatcatcgaccaagtgccgtatgaagctgctttgcagacggcagtggcaaacgttgaatcggccaaagcctctctggctacagcgcaactgacgtatgacagtaaagaggaactgtataaagagaacgtaatttcctctttcgatttgagtacggcaaaaaactccctgttggctgccaaagcacagttggcacaggccaaggcgcaggaagtgagtgcccgcaataatctttcttatacggttgtgaaaagtccggccgacggagtggtaggcacgttgccttaccgtgtaggagctttggttagttccgctcttgcccagccgttgactaccgtttccgacaattcggatatgtacgtctacttctccatgacggaaaaccaattactgggactgatccgccaatacggttctaaagaggaagcattgaaaaatatgcctgctatcgacctgcaactgaacgataagtcagcctactccgaacggggacagattgaatctatcagcggagtgatcgaccgttcgacgggtacggtcagcctgcgtgcagttttcccgaacaaggaaggattgctgcatagcggtggtgcgggtaatgtgattgttcctgttcaaaaaacagctgcgctgaccattccacaggctgccactttcgaaatacaagataagagatatgtctataaggtagtggacggcaaggctcaatccagccaggtacaagtgacccgtgtcaatggcggtcgggaatttattgtagatgaaggattggcaccgggagatgtgatcgtggcagaaggagtaggtttgcttcgtgaaggcactccggtcaaggcaaaggctgctcaaactccagtggcaggagtgacaaatgctaatcaatcctcatcaacagagacaacaacgaagtctccggcaactactactgaaaattaaaccaaggaggaatcattcatgaatttaagaacctttatagaacgccccgtattatcggcagtcatctctatcacgattgtcgtagtgggtatcatcgggctgttcagcttgcccgttgagcagtatcccgatattgctccgcctaccattatggtgagtaccacctattatggcgccagtgcggaaacattgcagaagagtgttattgcgcctttggaagaggcgattaacggagtggaagacatgacctacatgacttcctccgccaccaattccggttcggtgagcatcaccgtctattttaagcagggcacagaccccgatatggcggctgtcaacgtgcagaaccgtgtatcacgtgctacgggacagcttccggcggaggtaacccaggtcggtgtgaccacttccaagcgtcagacgagtattctgcagatgttctcattgtatagtccggacgacagttacgacgagaacttcctgtccaactatatcagcatcaacctgaaaccgcagattcttcgtatctccggtgtgggcgacctgatgattatgggcggtgaatatagtatgcgtgtatggatgaaaccggacgtgatggcgcagtacaaactgattccgtccgatatcaccggtgtgcttgccgagcagaatatcgaatcggctaccggttcgttcggtgaaaattccgatgagacttatcagtatacgatgaagtacaccggacgtctcattactcccgaagaattcggggatatcgtcatccgttccaccgacaatggcgaagtcttgaaactgaaagacgttgccgatatccaactgggacaggacagctacgcttaccacggtggtatggacggtcatccgggtgtatcctgtatggtgttccagacggcaggttccaatgcgaccgaagtaaaccagaatatcgacaaactcctcgaagaggcaagcaaagaccttccgaaaggcgtggaactgacgcagatgatgagctccaacgacttcctgttcgcttccattcatgaggtggtgaaaacgttgatcgaggctatcatcctggttatccttgtggtgtacgtcttcttgcaggacttccgttctacattgattccgctggtcggaattgtggtttccctggtgggtacgtttgctttcatggcgatagccggattcagtatcaacctgctgaccctgtttgcgctagtgctcgttatcggtacggtggtggatgatgccattattgtcgtcgaggcggtgcaggcgcggttcgatgtgggctacaggtcgtcatatatggcaagtatcgacgctatgaaaggtatcagtaatgccgttatcacctcttcgctggtgtttatggcggtgttcattccggtgtccttcatgggcggcacttccggtacgttctatacccagttcggtttgacgatggcggttgcggtaggtatctccgctattaacgcgttgactttgagtccggctttgtgtgcattgctgctgaaaccttatattaatgaagacggaacgcagaagaacaactttgcggcacgcttccgtaaggctttcaattcggctttcgatgtgatggtggataaatataagacgattgtattgttctttatcaagcgcagatggttgacatggtcgttgctggcttgttccgtggtattgcttgtgttactgatgaataacacgaagaccagtctggtacccgacgaagatcagggtgttattttcgtgaatgtaagtacggcggcaggcagttcgctgacaacgacggataaggtgatggaacgtatcgaaaaacgcctgatagaaatacctcaactgaaacacgtgcagaaagtggccggttacggattgttggcaggacagggtagttcgttcggtatgttgattctcaaactgaaaccgtgggacgaacgtccgggtgatgaggacaatgtgcagtcggtgatcggtcaggtatatgcgcgtacggctgatatcaaggatgccagtgtgttcgccatctctccgggtatgattccgggttacggtatgggtaatgcgctcgaactccacatgcaggataagatgggcggtgatatgaacgagttcttcaccaccacccagcaatacttgggagctttgaaccagcggcctgaaatatcgatggcttattcgacgttcgacgttcgctatccgcagtggacggtagaggtggatgcagctaaatgtaagcgtgcaggtatcacgcccgacgctgtgttgagtacgctgtccggttattacggtgggcagtatgtgtccaatttcaaccgtttctctaaagtgtaccgtgtcatgattcaggccgatccggtgttccgtttggacgaaacttcccttgataatgcttttgtgcgtatgtcgaatggagagatggcgccattgagccagttcgttacgctgacccgtagctacggtgcggaatcgttgagccgtttcaatatgtataactccattgcggtaaatgcgatgccggccgacggatatagtacgggagacgccatcaaggctgtgcaggaaactgccgaacagtctcttccgaaaggctatggctatgattacggaggtatcacccgtgaggaaaaccagcagagcggtacgacgatcattattttcggtatctgcttcctgatgatttaccttattttgagtgcgctttatgagagcttcattattccgttcgctgtgcttttgagtgtgccttgcggattgatgggtagcttccttttcgcctggatgttcggactggagaataatatttatctgcaaacaggtttgattatgttgatcggtctgctggcgaagacggctattttgctgacggaatatgctgccgaacgtcgtaaagcaggtatggggctgattgcttctgcggtcagtgcggctaaagcccgtctgcgtccgattctgatgacggcattgacgatgattttcggtctgttcccgttgatgatgtcaagtggagtgggagccaacggtaaccgttcattgggtacgggtgtagtaggtggtatgaccatcggtacgttggcgttgctcttcatcgtgcctactttgtttattgctttccagtggttgcaggaacgtttgcgtcccgtgcagagcgtcccgacgcatgactggcagattgaagaagaaatcaaagtgagcgaggaagaaaaatctaaagctggaaaagaataattgatgattaaaggttttagacctgaattaaaataagaactaatgagaaaaataatcattctgtccgcagcaacgcttatattgagtagttgcggtatctacaataaatacaaaccggtatcggaagttcccgaaggactttacggcagcgagtctgttgctgccaccgatacggcaaacttcggtaacctctcgtggcgggaggtctttaccgacccttatctgcagaatttggtggattcggcactcttgcgcaacaccgatatgcagactgcccatttgcgtgtgaaagaagcggaagccacgctgttgacgtccaaactgtcttatctgccttctttgtttctggcaccggaaggagctgccagcagcttcgaccgtggaaaggctacacaaacttattcgctgcccgtgactgcttcgtgggaactggatatttttggaaaggtgacaacagcaaagcgtcgtgcgaaagctgcctacgaacagagcaaggaatatgaacaggctgtcaagacgcagttggtagcatccgttgccaatacgtattacaccttgctgatgctcgattcgcagtatgagatagctgtggctaccgaagctgcctggaaagaaagtgtgaatgccacccgtgccatgaaaaaggccgggatggtgaatgaggccggactggcgcagacggaggctacctacttcaatatatgtaccaccgtactcgacctgaaagagcaaatcaatcaggcggaaaattcactggcacttttactggcagaaactccccaccaaatacagcgtggcaaactgggaaatcaacagttgccggaaaacttctccgtgggtgttcccttacagatgcttgccaaccgtcctgacgtgcgtagcgcagaattttcgttggcacaggctttctatacaacgaatgccgcacgtgccgctttctatccttccatcacgttgagcggcagcgcagggtggacaaacagtgcagggagcatgattgtcaacccgggtaagttcctggcctccgccgtggcttccctgacgcagcctttgtttaataaaggagcgaacatcgcccaactgaaaatagcgaaagcccaacaggaggaagcccgccttagtttcgaacagaccttgctgaacgcaggcgtggaagtgaacgaggcactggtgcagtaccagactgcccgcgagaaagccgactactacaacaagcaggtggcttctctgcaaacagcagccaagagcacaagcctgttgatgaaacatggcaacaccacttatctggaagtattgaccgcccaacagacgttgctcaacgcgcaactgtcacaagtggcgaaccgctttaccgaaatccaaggcgtaatcactttgtatcaggcattgggtggcggccgtatgtagggaggtatgtatgaatccagaaacactgcgttgccggatactcgactacaccaagcgggaaatgtaccagcatggtgccgacgggttgacgatggatgatatagccaggggaatgaagatgtcgaagcggacactctacaagctctttcccagcaaaacgagtctgttccgtgtctgtctttctgattttgctaacggaatcagaagccggatccagcaaaaacagatacggatggacagctcgtgcatggaggcacttttcatcacagtggatggctatctcaccctgcttcattcgctggggaagaagttgctgatggatattgctaccgacagggaataccgtgctgctttcgagcgggaggaggctttctggttgcagcagttgattgatgtcttgacgcattgtaagatttgcggttatctgcttcccggagtcgatcccgaccgttttgcaccggatttgcaggaggtcatctaccagagcagcttgcaaggcaccccgtacctggtgcagcgtatgttgaactatacgcttctgcgggggctttttaagatggacggtatccgttatattgacgaacacctgaaacctgataatttgaatgtttgtgtatgaagagaaagaggtggactaccctgcaaagggagctcacctctttttattttcttcgttcgtaaacggttggttacaacatagtgcctttatgaatccgattactttataacccttcgattatgcttaaaggtaaatcggtacattctgcgatagactcattgtctatccctttgtctttcatgttccgggctattttcagctgggtttcttgtgcacctttttgttcagctgcatccattgtcaccaaataatctcggtacactttgacgctattgtcgtatcgctccctgtcttccggagacatagaagccacatcagcgatatcttccaatttttcgaagacagcttttcgtgccttgaacggcatgcgttttaaagtttccatattatttaatatataaatccaacgttcaaaattcgtttcgcattcctcttcgtttttgttgaagagagggagagcgataaagatttcccggaacttatccgagaagagttctcctgtttccctgtcacttagaataacatccgtgcggagttttatgttcttgtcgataatgaaattcatcaagaaaactccgtatacggcttttatttcaaacttccattcattgcctacccttccttgattgacgatggcacgcgataaataataaatcgagcgttctttgaagttgctttgcatacggttctgcatttcaacgatgattttttcgcctgtgtccgtggtgcaatatacatcatagataatacctcgtccttccggatagagcggcaattgctcattattcaaaaactgtaagtccgttatcactcgttcaccttcgagcaggtcgttcagaaattcgattagtaaatccttagacacttctctgccgaatattagtttgaatccgtagtcggtgaacggattgataaatttactcattgttttgggtcgcttctttttatgttttgcaaagagacgtttctctttatacataaaaaagaggctttttcttcgtactacaaaggtacgataattcttggttttccatcccttttgcagtaaaaataaaaaggttccttgtttataggcagacttttccgctttatcttcccctgattagttttttcagtgtcccgttgtaggtgttttcaaattccgtcggatgattgagtgcccaaagaatgtaatcacccggttcattctttttgagtagggtagggcggtattgggaactaagaattttccataaaataccgccggggcctcccaattctttacgtcgggcaagggcgacaatcgcttttacggtctgttcgttccggatgccgatagtttgcatattaagtagaagtatagcttccgagcctcctcccgcttgcatcccttccgaaaccgtttcttttccaatcgatttatccaaagacaaaccctctacaacgacaggcgaagcctgaaaaacgctgtttgacggaacgggcggcatgctcctctcattctcctttccgtcttttctttccctctctgtctctatgtctttttttatttcagatttgatttcattttccatattcctttcctgtttacctttgatatctgtatccgtttcttcttttgtttgtggcattgttgtagcaaattcatggggttttgtaacatctttgccggagttggcactggagtcatccgtattttccggttctatttcactactctcctccttgataatccagaaatgttccagaggtaatttatattttctccgactgtcggtgatgattttatgatattgttcctgaatcgcttgtgaagtcagtacgccatactccttatatataagatcatcgaacagccccactgacaggcaatcatcaatgatggcctgcatttcctcctccccgcaacacgcttcctgggcgatgtcgaaaagagtgtctttgttccacaaaatataataacctttttctttatagatgaggcagagcagcgaagtgagtgcggcaatccctgccgcgtggtggcgacaggagatgcggcgtacttttctgtcctgcagaaaattgacatcgagggggaaataatctaatccgggtttggaaatgcgggccatgatgataaaatgctggttgtaaatggttgattattactgaataaattctgcttttacatcgaagcaggggcaggattttatatactcgtcaggtgagataatgccgtctccattgaggtcaggactggtgtcccgatgccctatcacctgcttcagagaagggaagacaaggcgcaaatcttctaccagccggacgagtgcttcacgttgcgcttccgtccgtgtgtcagcaggccggccgttcctgtccaatccgccaatgtagcagatgccgatagaccgatggttccaacccgtgcaatgcgctccgtcgagagcaacatctcttcccggttctatcgtaccgtcgagacggatgacgaaatgataaccgatagaacgaaaaccacgttgacgatgccagcggtcgatgtcggtagcggtaaaatcctgtcccgcacgagtggcggaacagtggatgatgatcgtgtctttcatggcagaatcctcctttcctgtttgcagacggcacgtgagataaccccgaacgcaatagcctcctctttggacagttggcggtaatattgctttgttactgaatggagcaccggagagaagggagcatccatcggcggcgttgtcgtttgattaggcatggtgggccgattaggtattgtcgtccgattaagcactgtggtctggttaggccttgtctgaaccataataaaagcatctccccgatgatgttgcacacgcaaggcgtgttgtttcacgcggtccggatgctttagttggaggataagccagtttcggtgcgcaggcttcagacgttcctctctgaccatttctttcatagacgggtaggcacgcaatactttccccgttgcatccgtaacggcgaaaggtgtttgatgagatcccactcccgtacgtcgtaatcccgtccggatggcgtgcatcatattggtgtatgcatcgcaccattcgaggtttgacacgtggttgttcatcgtattgccatcgaggtggttaatctgtggcagctgctccgggttggggatgaatgctttggcaaccaaacgatgaattttgtattcgatacaaacacctttattcggcagtatgacagtttcgtaaccggtccccatgattttggcacaaaggatcaactttgatctgcccttgaaactcaatacccgtccgtgatctgaaatcatatagtcggggttttcttcaataaatctccaattttccatacttgatattgataatgttaataaaattatactctgttaaaaaataatcgtttttctgaatcatgcggggagaaacggcgtttcctccatctgttaaacggcggtttctggtgcggagaaacgctgtggtctgtatgtgttaaacggcgtttcttcctcctcctctgtatgaggttcgagccgttcggcacaatgaatcagaaactccagttcttcccggcagccttgaatggcctcgtatagcgaatctacgttatactgtctgcaaagcgcctcccattcttttcgttcctgcccgttcattccgttcttttgcagattcatttttacttgttgctgtcttgcccgtccgtttcgatatccagaaaattttcagcgtgaaaggtgcgccagcctttggcttcgatatcatagtagacaacgaacgtattttccggtttgggtagatacggacggtggaaactatgttcatatccggtgagggtgccggtggcgtgtcggatggttccatcctgtttggtgtagcggaaacagacatttccgtgatgcatctgccggatgagagcccctatccggtgagccgtgacgagtgcatcgtgccggttcataccgttgttttgccggatgacggcagcttgcttcattagctgtacccgttggaaggaatgatttttttcagtttcagtcattttgattcgttttaatgatttgattatggggacaaaggtagagagcaggtaatgcaaaggctgtccaagcttgaaccataatgaaacgttgaaacgattgagtcatgattgagtgctatgtgagaaaaagtaaatggcggaagattaaacttatctgtggcaaaacttgtttattatttattttagaattacttttgccacagaataaaggaggtgactaatgaaaaccatgaatcagattgtcggagagaacttgaagaaaaccagagaattatccggttttacgcaggagcaggtagcgaaatctatcggtgtggagcggtcggcttatagtaactatgaaagcggtgttcgtgaagtgccttttcatttgttagagaagattgctgatttgtttggctgtgaagcgtttcttctgtttgaagataatgtagaagccgacaatgagattctggctactgcttttcgtatctccgatgttgaagaaggggatttgaaagaaatagcccattttaaagatctcgtgaagtcttaccttaaaatggaacggattggaaatggctccaaataaattcatcatagaaagacaagtggcggaatttcgcgcggataacggattgagtgcttcggaagccattaatctgaaaagtctgttgctgaaattgaatgtcttgaccattttccgccctctttccgataacttttcgggaatgtgcctcaaagacggttccggacatcggttcatgctcgtgaattcttcccattcaagaggcaggcaacatttcacgattgcccacgaactctatcacttgtatattgaaagtaaaccaactccgcacaaatgcaacccttgtagtggaagtaaagaccccgtagaacagagcgccgatatgtttgcctcttctttgctgatgccggagacaggactttgtcaacttatcccggaaaatgaactgaaaacaaaaaagatctcattggcaacagtgttgaaattggaacattacttttctgtttcccgctctgcactgctttacagattgctgaatgttggtttactgaccaatgctgcacgtcttgcgctggcagatgaaccggtgaaacactcggctttgtgtttcggttatgacactgcattatatgatccggcaaacgaaggactggtaatcggagacttcggcgaaaaagcccgctcactttttgaacaggaaaaaatatcagaggggcactattgggagttactccgcaaaataaacacacatgcaacagaagaagacgaaaataatactggatgctgacgttatcatccattttgtgaaagcggaagcattttctttgttgccggacatctttcccgaatacgaatatgttattttggtttctcccctacgggagcatcgttgaaagattatttccaattacttaaaacgtttggacacggtgagagtgcctgcatgatttattgcagagagcaccgtgatgtgctgggtagcagtaatttgaaggatataaaggactattgtttgcagaacggtataacttttctgactactcttgattttctatattatgctttttgccggaagaagctttcggcagaggaatgtaacgagtttattgctaaggtaattgcttcagggagcaagttgccggaagttgatattacccgctataaatgtacagtcgcgatttgacatcgcttttctattctcttaatttattatttttagtaatagttccggtatcttttcttagcgcaaatcacagcttttggaacgagtgatttctttcctttttggcagattttatttcatctattttcttgataataccggtaaggtagaaaatgggtaccccaaaccctctttctttgtgaaaatatggatgaaaaatatagaatgtgtcatgcttgaacatatatgttaaaataagcattgtacttttgtcgtgaattttatatgtaaatattaaataaaatgtaaaaaaatgactaaggtagaaagagaagtggtttttaacagtgaaaatggtcagaaagaaatgaccggtgtacgtcacagcgacgatgatgttaagaagaaagtaattgattgtgtttttaagttggggcaactgaataatattccagaaaaatatgttgaaaagaattcggattgttcgcgttcgtccgtggggcgtgtgtacaggtgtaatttcgacggtcggagtcctataccaaattggacaactatttttaattttttctcttgtgtgattggaaaggcaacgattattgtcaatattccggaggtgttgtgctggattctgaagctttttctaggagattctgcggatgtaggctatacagttgatgatagtcatcatattcgtatagatattcagtttcatgacgataaaacactgttcctggagactggtgaaaaggaaggaaaggtgaagaaaaaagatggaaaatagaggaaagcgggaggggagttaccaagttcttgatgaacttggtacattattgataacgaactttccatcgaggtcggtggtggttcctattgatgtacctttaactaaaacggatgctcctatgacgggctggttgtcttcctcggagaagacaacgcccattacctttctggaggtttgagcgattgccaggctaatgcctgctagcaggcaggttaataacagcgttagttttcttttcatatagtttttatatagtagaatagtctgttttgctatcttacgattcgcaaaagtaaccacttttttagaaaaacaaagaaaaatatgaaaaaaaatatgaatttgtgctgtcgatacaaaatacttgtagcaaaaggacttaaatacaagataagtacatgaaaggcggtttcttgtttctttttggtgattaataaacgaaaataagtatctttttgataaataaatgtggataaattcgtagataagatgtttaataacacataataatccgcaaataaataattgcaggtagaaaaaagatagtttattggacaaagaaagaaattctatccgtagtctcttatattaataccctaattggggagacgagagttgctgccggacttgaagtttgctacatgaaagatattttctaccttttcagtaagtagataaaaagcaaaaaaggacgatttattttgcgtttcacttccttttttgcttttcttattcccctttcggtgttttcttttttatatttattaaatattttgtgctcaagcacttatggaaggaggggcagaaaatgcatgagttcatcaagaactttgcaaatcacctatgtcggcatgaagtcgcaggatgttcccatcaagtccgggaccatcaaggtaatgatgaaatccgattccgaagtattacaggaagtggtagtgaccggtatgcagaaaatggataaacgtctttttaccggagccaccaaacaattaaatgccgataatgtgaagctggacggtttgcccgacattagtcgcggactggaaggtcgtgcggcaggagtttccgttcagaatgtttcgggcacttttggaactgcccccaagattcgtgtgcgtggagctacttccatttacggaagttccaaaccgttgtgggttgttgacggcgtgattctggaagacgccatcgacgtaggtcccgatgatctttcctccggtgatgccgagacactgattagttccgccatagccggactgaattccgacgatatcgagagtttccaaattttgaaagacggttcggcaacctccatttacggtgcacgtgcgatggcaggcgttatcgtagtcaccactaagaaaggacgtgccggagtcagcaagatcagttatacgggcgagttcaccacccgtgctatccccagctacaaagaattcaatatcatgaattcgcaggaacagatgggaatctacaaagaaatggaacagaaaggctggttgaacagtgccgaccttttccgcaccagagacaccggagtgtacggtcgtatgtaccgcctcatcgacgaatacaacaacagtaacggccaacgcggactgctcaacaccaccgaagcccgtaacgcttacctccgcgaagcggaaatgcgcaacactgactggttcgacgtgcttttcaccaatgccgtttcgcagaaccattccgtcagcatcaccgccggaacggaaaaatcctctttctacgcctccttgagtgccatgctcgatccgggttggtacaagcagagcaaggtgaaacgctatacggccaatgtgaacacaacctataatatatataaaaatctgtcgctcaacctcatatccaacgcctcctaccgccagcagaacgcgccgggaacgatgaactccaccctcgacatcgcatcaggaaagatgtcccgcggattcgacatcaacccttattcatacgcgctcaacacaagccgcacactcgacccctctgtggactatatcagcaactacgccccattcaatattctccacgaactcgacaataactacatcgaaatcaatatggtcgatgtgaaatttcaaggcgagatgaagtggaaagtgattcagggactcgaattgagtgccctcggagccgttagataccagacttcatcgcagggacacaacgtgctcgacgacgccaatcaggcaatcgcctaccgcaccggtatggacgacgccaccatccgcgagcaaaacaaactgctctataccgaccccgacaacccatacgccctgcctattaccctgctgcccgaaggcggtatctaccagcgtcaggaccgccgtatgctgggactcgatttccgtggaacactctcatggaatcatcttttcgccgaaaagcacatcaccaacttctttgccggaatggaagtgaacagccttcaaaaaacatattcctctttccaaggctggggaatgcaatattcgatgggggaaattccgtcctacatctaccagttcttcaagaacggtatcgaatccggttcgcgctattacagcctgggacactccgaaacccggagtatagccagcttcttcaacgccacgtattcttacgacggacgctacaccctcaacggcactttccgctatgaaggaaccaaccgcatgggacgcagccgttcatcccgctggctacccacatggaacctgtccggtgcctggaacgtgcatgaagaatctttcttcaaagcgctgcaacccaccctttccaacctgacactgaaagcctcatactccctcaccgccgaccgcggcccggcggaagtgaccaactcgcaagccatcatccgcagcttctcgccctaccgcccctttaccgacattcaggaaacgggactttatatcgatgacatcgagaacagcgaacttacctacgagaaaaagcatgagctgaacatcggcattgacctcggcctgctcgaaaatcgcatcaacttctccgccgactggtaccagcgtaacaactacgacctgatcggtgtagtccccacacagggagtaggcggcgtcatcaacaaatatgccaacgtagccaccatgaaatctcacggtgtggaattcacgctctccacccgcaacatccgcacgaaggatttttcatggaacacagactttatcttctcctatgccaagaacgaagtcacccgactgaaaggactcacaagtatgatggaactcgtttccggcaacggctttgcccgcgaaggataccccgtgcgcggactcttctccatcccttttgcgggacttgatgaagacggtattccgcaatacctcatcgacggaaaagtgactagcaccagcatcaacttccagaaacgcgaaaaactggattacctgaaatacgaaggtcctaccgatcccaccgtcacgggaagtttcggtaatgtattcacctataaaggcttcaaactaaatgtctttatgacttactcttttggcaacgtagtccgcctcaacccggtgttcaactacaaatattccgacctcaccgccatgccgcgtgagttcaaaaaccgctggactgtttccggcgacgaagcgagaacgaatatcccggtgatacttagcgacccgcaatatagggcgaatacatcgctttatcttgcctacaacgcctacaactattctacggagcgcatcgccaaaggcgattttatccgcatgaaagaaatatcactgatgtatgagttcccgagaagctggatcgctcctgccaaaatatccaacctgtcgctcaagttgcaggctaccaacctcttcctgatctacgccgacaagaagttgaacgggcaggaccccgaatttgtgaacaccggaggggtggcatcccccgttccgcgtcagtttaccctcaccctgcgtctgggactgtgattgtaacccccaatagagaacccgaaaaaatataagatagatgaagacgaaaataaaccatatactccctgtgctgctgctcaccgcagcttccggtctgactaccgtttcctgcaatgattttctggacaaaacaccggacaaccgcacggaactgaacaccgaccagaaaatagccaaactgcttgtatcggcctatcccgacgtatcacccaacgaactgttcgaactctacagcgacaactccgatgatagcggccccacctacggttactaccagctttccgaaaaggaatgttacaactgggaagataccaaagaggaatatcaggacacacccaattccctttggggaggttattacggtgcaatttcagccgccaacatggcactcaaggcgatagaggagaaaggaaatccggcatcgctcaacccgcagcgcggcgaagcactggtgtgccgtgcctactgccatttcatgctggcaactatcttctgcaatgcttatgacactcatgcctccgaatcgttgggaatcccctatatggaagacgtggaaaccaccgtgtctccccgttacgagcgcggcacgctggaagaagtgtaccggaaagtggagcgtgacctcctggagggagtggaactgatttcggacgacggatattccgtccccaaataccatttcacccgcaaggccgcctatgcctttgccgcccgtttctacctttattatatgaaacccgatttctccaactgcgaccgggtgattgactttgccacccgtgtgttgggcagcaatcccgacgacctgctccgcgactgggaagcattgagcaatctttccgtgaacggaaatgtgcaggcagatgcgtatattgcttcttccaatgaggccaacctgctgataagcagcaccgtctccaactggggcgcactcggaagcgactacctggtaggcccgcgttacttccacaaccaaacgctcgccaccagcgaaacctgtctttctgcaggactgtggggcagctcggattatttgtatctgaaacctttctctaccaccggatttgtagccagcatcctgcgcaagagcggactttatgatggcggctacctttattatatgccggtattgttttcaacggacgaaaccctgctttgccgtgccgaagcatacgcgttgaagaaaatgtacccccagtcggctgccgacatcacaagctggcaacgtgcctacacccgcaacaaatcggccctgacacccgaccagatcaatgcgtattatgataaaatgaatttctatacgcctttcacgcaacagacgcccaagaaacagctagctcccgatttcactatcgaggaagggatgcaggaaaatattcttcactgtattctgcacatacgccgtgtcactaccctgcacgaggggatgcgctggcccgatatcaaacggtacggtattatgatttaccgtcgcaacatggctactcaacgtgtcaccgacgaaatgccgccgaacgacctgcgccgtgccatccagattccgcgaaacgtgatcgtggcgggaatgcaacctaacccgagaagaaactaacagagaaaaaagtgaaaattatgaagaaacagatcatttactctttgcttgctctcaccacagtctgcctgggggcttgcaacaataacgacgagatagacaccgcgaacagcatcttctctaccgaaccgctggagagaaatgctttcgactactggctgctcgacaactacacctatccttataacatcgacttcatgtaccgcatgaaggatatcgagagcgatcataaatacaacctcgtgcccgccgactatgacaaagcggtggcactgtcgaaaatcatcaaacacgtctggatggacgcttacgtcgaactggcaggaatggattttctccgtgtctacgtacccaagacattccacctcatcggatcgcccgcctacgaaagtagcggtaacatggtgctcggcacggcagaaggcgggaagaaaatcaccctctacaacgtgaacgacctcaacataaagaagatcaatatcgaaaagctcaacgagtattattttgaaacgatgcatcatgagtttgcccatatcctgcatcagaaacggaatttcgacccttctttcaaccgcatctcggagggaaaatacgtgggagccgactggtattactacatgaccgcccaaggtgccatgccccgtacggacgatgtggcctggcccgacggtttcgtgacggcttatgccatgagccagtccaacgaggattttgtggaaaatatagccatgtacgtcacgcatacgcaggcctactgggacaatatgatgacggcagccggagaatcgggcgctgccatcatcaacaagaaattcacgattgtctataactatatgcgcgacacatgggggatcgacctcaacgaactgcgtaagatcgtgctgcgccgccagcaggagattaccgaaattgacttgagcactattcaataagtgccggtcacctcttgtttttttgattgacgattggatgattatttaattacacattattatgatgaagaaaaatagaacgatatatttcctgttggcccttgtctgcctgggtttgcagtcgtgcctctttcaggaagaagattattttgacgattcgtctgccaaccgtgccacggccgatgtgaagcgttgcagcgaactgctggaagcagcacccaacggatgggtgatggaatattacgtcggtaaggactactcgctgggaggtattaccctgctttgcaagttcgacggccagcgggtgacgatggcttcgcagatagcgggagcggatgagacggtcagttcgctttatagcgtcaagtccgagcaggcgacgatgttgtctttcgatacctacaattacctggtgcattatttcgggcaaccgcagggaagtatggccgacgacccgaacggaacgctcggaggcgactacgaattcgtgatctccgatgccaccgccgaccgtatcgaactgaaaggcaagaaatatggcaaccgcatcgtgatgaaggctttttctgccgaccagacgtggaagcaatatctcacccggataaagaaagtggaagacgatgctttcttttatgaatacgacctgcggatggacggactctacaccgggcaaatgctacgcagcaactatacgttcattgtgacctattatgacgaagttggaaaggtgcatcagaaaaccgtatcttttatgtttaccaccgacggaatgcgttttcacgaaccggtgacgatagacggacaaaccatgcagaattttgtctggaagaacgaggagatcagctttgtctgtaccgacgaaggagctacaggagtgaagatgaaaggcatctacattgacggatatcagagctacgactattatccgggcacttatttgatggatttctaccgcctgaacggtgcgacgaaccaactggaagtggcttcgcaggagattcaactggtgaagaacgaggacggcaagagctactggcttaaaggactcgaatatgacattctggtaacttacgacaagccgcgtggcggactttccatcctgccgcaattcttgaagaaagtacagggaggttacgtatatctggctatgtgggatttgatgaatgattacgttttgcgcagtccggcaatcggtcttatcagttatcctaccaccgacggcatttatctggtggacaatggagtgtggataggtgaaatctccggatttatcttcggtgtgtacaactcgcaggatgaggaggcctctttcatgggatacacggatgcagttgcagcaatcaggttggttaaaaaaacaatagaagaatgatatgatgaataagttttttatactgttattatctgcgtgctgtctgctgacgacagcgtgcgacaaggaaaacgatgaaacggtgcagggcttccgcatcatgaaggcggacgtcgatctggtagccggaggcggaacagtggaagtggctttgcaggctaccggagaactaactgccgtttcgggtgcggactggtgcagggtaatcgaagtgacaaacgaaaagataactttgcttgtcagagccaattatgaatatacgtcacgtgccacgcaggtgaccgtgagcgatggcaatagcgaacagaaaattgtagtgacgcaggagggaaatatttttgctcccgactccgaccagcaggtgatacgcctcggaaatgctccttcacagacgattgtacgggtgaatagttcgtttgatttcaaagtgagcgtgcagcagggaatcgactggctggaagtgccggctgcttcaaaagaagatggtttcttgcttgtgttgaaagagaataaaaccggtaatccccgtgcctgccagttgttggtcagcaccaatgaagggcggaagttcctttactacgtatatcagtatgaagtgacagacttgctcggagcgtggggaaacagccggatttatgtgaaatgggacacgaaggatatcgaagacgcctatcccttgtcggctactgaaatttcgaagaatgtcgatggcgagggatataccattaagatgtcgttggcaaatactccggcggcacaatatctgaaagaccccgcaaaggctacggtttcattgcaggctacctataagaatggatcgtttgtggtacctatcggtgcggcacagaaagactttacagtcgtggaagaggttgcggatgaggcggcagaaggcgcatcggacggaacatcggatgatggggcaggtgttgttttgcaaaccctgtacggtttttctgtagcggcttcttccaatatttattcgaaaggaaatttcggtttcgctcctgtgctctatcaggacggttctgtcggaatcagttttcaggacgtggccggagcaccggaaagcggatgctacctggcgatagcattgtttgacggacagcagttcctgaccggaacgctgaaagattatatccttttcccggatattgcacttttcagataaaacgaatattaccttgatgaataaagaaaagaactaccgttgtgaaacggaatgagaatttactaattctctcttaatttaactttactatatgacaggcggggatactcgcgcgaagaatgggaatccttttcccgagcttactccgccttttttatgattcccggtcgctacggaagttcttttcaatgatgtaaaatatataaatcagtctgatatggataagaaaataatgaagttgttgggtgtctgcctgttcgctgttgcgtctgtgggggtgttgaccgcttgcagtgacaatgacgccgaaaatccggagggaggaaaacccggtggagaagacgtaaacccggcgccggaagtggtggagtttgtcaactccaacttggtgtactggggagataaagacggagtgggcacagatcattttgtattgacgctttatacggatatggaagtggatgctactggtaatccgataggaccgggcaagatcatggcgttcagcctgaatgtcccgccatttgcttcggaagctacggaatttccgctccctgaaggcacttttgatgcagcattgaacggatatacgtttgatgaatggacgttcaacctcggatatatgaatcaaatcgatttaccgaccggaaaggtggaaattcctgccggaactttctatggtgaagtgaaatcctactcttcgagtgtcgatgccgacttgctttccgatggtaaaatgacggtgaaacggatgtccggcggcgaatattcgattagcggaacgttggtaggcaatctttccttgaaacattatttcacctatacgggaaaagtaaccaccatcgaccgtcacgaaaacaaggttgaaacttctaattctaccctgaccgccgatattgcactgaacggatggacgcaagcccgcctgcaggataagggagattcttattatctgcaagatgaatcgtgtcgtgtagtcgagttgtatctggcggaagacggtataagtcttgccgacacctggccgtccggtaacggaagagtattgaaggtggaatttttcgtggaatgggctacggatgtaacacagggtattccggcaggcacctatacaatggtggcgcgtgatgagggatcgcagggtatcccgcgtgagttgctgaaaccgggaggcattgccccgggttaccccaatgtctttacatatccgggaggaacctggtatgagaaactgcagaacggagccatgaaagaatatgcacgcatagacggcggaaccatgaccgtggcacgcgacggtgacaaacacacgctgacgatagactttattgactgtgataaggaacacccgcaccatgtgcgtaccacttattcgcaggatactcctattaccgtattcagctatcgcccgcagtaaatacgggtggatggcatcattttactaataacgcgattttataattaaccctaaaaataagaaatatgaaaattagatttatttcctttttcttgttcatgctggcaatgagttgtttggtggcatgtagtgacgatgatccggcccctgatcccgaaccggagccggaacctgtggaaactgtgaatacgtacacgtataaggataagaccatacaagcccaatcggtgtcttgttttgaacaggatggcattgtgtatgtgtgtatgagtccgttgcagagtttggaaacgcttgaagactttatgaacagcggtaaggaatatgtgatgttgggagtgagtaagagtctggtgggcagcccggttacgataggcggctctgaagatgacaattatgtgctttattacatggatgccgatggtgaggctattctggccgtcaatccttatgagtggaaagaggtgctgacgcaaggtaagttcaccttgacgatgactccgggtgagaatgaaacatcggctgtgaaagctacttttgattgtacgctgaaaagtggcggtaagtttacaggggaggctggttgtagctacaaggctcctgcaaagttgcccagtgaattttctttcggaagtgaagtgcgtccgttgaaatcggtggtggctactgtcatcgggggaattcaatatttttatcttagtccgtacgcaggactgacaacggtggaagatatgtcggatacggagttcctgatgatcggaatcaatcccgctatgttgggacaggtattggatatcacgtcttatgacggtatggattatgctttctataatatgacagaattgggagctgacgacctgactgcggtagatccttatggatggtctgaaatatgttcggcaggtaagttcaaagtggaaaagacggataatcgggtgaaaataactttcagctttactttgctttcgggtggaaagttcgaaggttcttacgagggtgcttattctgaaattaaacagagtacgacgaatatattaacgttgaacggagaaaacacgcgtgacatcaaagctactttctatgaaaagacggatgaaggagtggcattgtatctcactccgtcgagaatttcgtctgctgcggacttggagaatgtaaacacatattatgtgcgtctctttgtcccgaacgcaggacttaacgggcaggaagtggatataacaaataccaatctggcttttgaatttacttattatagcccgtatgacgaagaaagaatacaaatatccaaaggtcgcctggaggatgcggcaggtacgttcagtgtatcgaaatcagcggataatgaatattcattgacgcttaacctcaaatatttgggtgataatagccttaaaatatcaggtaactataacggtgctttcgcggtgtatgatacgacgatcccgaatgaatatcgcttaggggtggacggtactccggtcactatccagtctgtggtgatagataagacggatgcggatatttgtgttatttacctttcacgacagccaggtatcactactgtggtgggaatgtcggcagcagatgcagtggtgcgtctttcgaaaacaatgctggatggagtgctccgcggattctccggtgatgatgaaaatgtgaaaatctcgattacgtatgaaggagtgacttacagtcgggctaataccacattgggcaatctggctctgggaggccggacttcggtgtctcttcagggcaatgaagttgaaatgacttttgaagtggtaggtattaagaaatatggcgatgccagtttgtccggctactataaaggtgcggtgacagtaatagagtgacgatttaatgaagtgtattcatgaagaaaatcttattgaaatatttaaatttatatgttttatcgggattgcttctggtgggttttgccggatgtagtgacgataaagataatgatccggtaaatcccggtccggatgtggaggaattgccttccatcggtacttattcattccggggggaagcgaacaggatcgtgtccggtgaggctactatggacggtggttattttacctgtatcttttctccggaaaagatacaggacgggaaaactagtacttattttttgttttctctgggtatgtattgggaggggcaagtggtggatgcatcgaccttgtaccaaaacgaccagtatttctttatttacgaagatccgttctattattatttccaataatcataaagacatatataaaatgaaaacaagctccaaataaatatagataaaatagctatatatcaataatttacatacaattttttattttcagttgttttctacgttttcagttgttttgctctttttaggtgcatttttgtttcttatttgtttcttgattccgctttttatttgtacctttgtgataggaaataacaaatgaaaggacacaaatatgccaaggaccagaaaaccaataaaagtgaaagagccgattcgtcttcgaacgaaggaattggccaatggcagcaagagtttgtatctggatatataccgtaatggtaagcggacatacgagtatctgaaaatgtatcttattccggaaacggatcgtaatgcccgccaacagaatgaaacgacaatggctgccgcaaatgcaatcaaatcgaagcgtatcatagagttgacaagtggtgaagccggtatcatgaatcacaaggataaggtttatctgctggactggatgcagctctataaggaggaacagaagaaacgtggcaagaaaaacacaggtcagataaaatctgttaccgatatcttgaaagagtatgcaggagaaaggttcacattaaatcagattgacctcactttttgccacggctatatcgactatatgttgacaagctaccgtcccaaaggaaagcccctctcggcttctacgcgtaatacctattaccagatattcaacggtgcgttaaatgccgctgtccgcgcgaaacgcatcttaaagaatccattcaacgaaatggaaaaatcggagaagcccaagatgccggaaagtgtgcgttcttatatgactattgaagaagtgagattattaatcgctacaccaatgcagaacgagggggtaaaaagtgcctacctgttctcctgcttctgtggactacgtatcagtgatattatcggattgcaatggaaggacgtgtttattgacaacggccaataccgcttggcagtagccatgcagaagacaaaggagccgatttaccttccgctctccaatgaagcgttgaagtggatgccggaacgtggggacaagacagcagacgaccatgtgttcgatttgccttcaggtatcaaccagcttatcaaaccatgggccaaagccgccggaatttccaagcgattcacctttcacacggcccgccacacgttcgccacaatgatgctgacattgggagcagatttatacactgtatctaaattgctcggtcatacatctgtaaagatgacccaagtgtatgccaaaatcgtcaataagaaaaaagacgatgcagtaaatctgactaacggtttattcgattgacaatgcgatgagcatcagaccagatatctaaacacttatttagggtgttgttccggcaggattttctttcgggagcaacacccttataatatattataaatccaatttaaagtatttcatcatgaaaagacctaacaatggccctctctctttttggagggaagaaacatctgcaccattttgttgaagaacaggatgtagcgaaagaatttttcgcattgctcgttgaagcaaaaacaatgtatctccgtgatgtcgtggcgggtagtaagcagtaccaccgttacgtggaggattttgtaaacagccaccggtatatcgactgcaatcatgcggtctgccggaactgccatgaaatgaacattcatatcgtcaaaggattattaaacgattgttccaatcttatccgatcactttttaccgaagcagacttctcgttcgagaagtgtatggaactgaaacgaatgtatgatatgtttgtgccaccatcacagtccatcacgtgctgcaaagacggcccgacaaggatttatcctctttcttttggatgcaatctcactcgtaaacagatgataggtattacggcttgtgccaatgcttatcatctgttttgcgtttctaccctacacgtggaagatatggaagccctgctttcctgcaaggaaggattctgtattcgtgtaaacaatatccgtcatgtggccatcctgttcgatacactccttgaacactcgttcatccaagccaaatggcagaccgttctcagtaatggacggttcttacaaaccaaggacggaaaaggattcgtttcagcttcaagcctttcatccgctctgtctgctctacgcaacaacatgacatcagcaggttacggtatcaggcgagccattgatgaactgagagagtggtaagaagtgccaataagcgaagtatgtgaaaggtaaaagcgtgatagttgccgtgatacgtggttactatcacggtgcaaactcatgctgaccttttgggttgccctatctttgccctccgttagcgcgctacataacggagggcatacttccattgtctaattttataataactcatttatgcaaaataatagattgacattcatggaacggctgagtgaacggcttacaagcgtcgaagccatcctaaagaaattagatccgatagagagtctgttggaacgcatcgcattgctggaaaaaaatatatataccaccaaacaggtgtttaccttccaagaggcttgtatgtatatcggaatatccgagagtatgctgtacaagctaacatcaggcaaggagattccgcattacaagccacgtggcaaaatgatatatttcgccaaagaagatctggatgaatggcttttgcagaattatgaaccaaccgtagatgaagcagcacgtatggcaaacgaggccgctgccacacaacctttctttaatcaaagacgccatggaaaacgaaagaagaactgactataatgtggatatgaggccggaggaggatttcttatcggatatcctctccgcctcgcagattcgggcgacggacacctatgaaacgccgccacagattatctggatagacaactcgaccattgctacgctcggcaacttcagcgcatcaaccggcaaggcgaaatcaaaaaaaacatttaacgtttcggccattgtcgctgcatcgctggcaggaaaacaagtgctgaactaccgggcgcacctcccggaaggtaaacgtaagattctgtacgtggacacggaacagagccgctttcattgtcataatgtactggaacgcatcttgcggcttgccggactgcccactacaaccgacagtgaaaacctcgactttatttgcttgcgcgaatactctccggcaatacgcattggggtcatcgactacgccttacgtcaaagaaaaggatacggacttgttatcatcgacggtatccgtgacctgatgcttgacataaacagcaccggtgagtccgtggaagtcattaacaagatgatggagtggtcatcaaagtatgacctgcatatccactgtgtgctacacttgaataaaggagataacaatgtgcgcgggcatatcggtacggaaatgagcaacaaggcggagactgtactggtcatcagcaaaaacaacgattgtcccaacgtcagcgaggttcatgcgttacacatccgtgagaaagagtttaaaccctttgctttcactgttaatgagggcgggctcccggttctcgcagaagggcatttgtttgagaatgccccacatcagaaaccgaaacagcggacgggttttatggaactaagcgtcgaacagcaccgtgaagccctttccgctgcgtttggagacaaacctatccgtgggtttgaaaatatgctgcaagccatgatgacagcttacgaggcaatcggatttaagcgtgggagaaacgtaatggtcaaactgctgcaatatctgactgacaccttaaaactggttatcaaacgagataaacttttttattatgacatgacacaggcagaaaccatgcttttcgatgaagaatgagagcgggcgcgggcctatataattcagtttaatttagtatttatatatatagggtcgcaaactaaactaaaccgcttttgcgcaaacaagtgaaaagaatttgaatatgaccatagatgaagcaaaacgagtgcgtatcgtggactttttggcccagctcggccaccgtgcgcagtatatgaaatcagagcaatactggtatctttcgcctctcaggaaagaggtgacgccatcgttcaaagtcaatgaccggctgaatgaatggtatgattttggcgaggccaccggaggcgaccttgtggaactgggtaagtacctttgcgaaacaaaaagtgtgagtgaagcattagcatacatcgaacggcatgtcaatggtgtatcgctaccgaaaacccggacattgcccacaacgttccgacccgtggaagccgacatgaaaaatctgattatcgtgccgctgcgacaccacgcactgttctcatatctccattcacgtatgattgattcggatatcggacgaatgttctgtaaggaagtgcattacgaactgcgccagcgacgttactttgcactggcttttggcaacatctccggtggatacgaggtgcgaaacccttattataaaggatgtatcaagaacaaggacatttctttgatactccaatcgcgtggtgagacacagagccgtgtctgcctgtttgaagggttcatggactttctgtcctatctgactctcaaacagacggacgatagtgccatttgtattaatgctccctgtgaccaccttattatgaactcgatcagtaatctgaaaaagacattgacgtatctgcaaaaatacacgtatatccactgttaccttgacaatgaccttgccggacaaaagacagtggaaaccatagccgggatgtatgatggacgcgtctataacgagtccaaccgttatgccggttacaaagacctaaacgactacctacgcgggaagaaacaatgaacaacccactccctaagctctccttcacggagggctttttttataccccaacttttcctgctttcttatgtaaaatcgtatttgaatatgattttgtaatatgatttttgtattttgagaaaatatcatattaaaataatatgttttgtagccaataattttatctttaaacttatccattcttattttgcagccacaatcaaatataataaatcatattacataaaaagatatgaaatcatattttattttcaccattgtcctgacagttgcctatctcgtctattatgcggttatcatcgtgcaggacctttatggaaaaaaaggaaatggtaagccggaagaagaggtatttgacctcggtgcgccggaagatgaacagagtgtgtccgtgacggagagcgatacgggattcaatgtgggtaatgagaagtatgaaacagatgttgcccctaccgcttcacctacaccacaggagacggaaaccgcagagaataatggcgagatagccgtggcggagaagctgaaacggctgaaagcccaagcggaggaacagatggaagaaaccgagacctacctgtcggacgcatacacggcagacgaactgtacaaagcgatgcttgccaaaggaaagacggacaaccgtccggaactggtatggaaacctctcaaagaccgattgtaaaatgtcgaaagcaaaaaaaatattatgtgcactgtgctttgtcccttatgcggtattcgccaaaagcggcagcgtaaactacagttggggtgcagacgcacttgcaacgatgcacgacttcgtggtgacgatgatgctgtacgtgctgtacatctgctacgctgtcgcctcggttttcgtagtcgttgccgcgctccaaatctatatcaaaatgaacacaggcgaggacggtgtggtgaagtctatcgtatcacttgtcggtgcgtgcctcttcatcattggagcttcaatcgtgttccccgctttcttcggctaccgcatataggtggctgacaggagtgtaaaaccaattcaaaaatagaagtaccacaaaaaatgtaataaatatgtttcagaaattcaaaagaatgtgccgaaaggcaaagaaaaccatcatgcaagtttccaccaaagtaaaaatgttaatcattgccctgttaggaggcatacctgctatggctcaaagtacggcaggcgattactcagccggtacgacagctctatcaaccgtagccgaggaaatcgtgaaatacgttcctgtgatggtcaaactctgctatgccattgctggtgttgtggccatcatcggagccatttcggtgtatatcgccatgaacaacgaggaacaggatgtcaagaagaagattatgatggtggttggggcgtgccttttcctgattgcggcagcccaagcattacctctattcttcggaattaacgcataaacagcctggaggaatgactaataacggacgttatccggattacccgctgttcaaaggactgcaacggcctttggaactgatgggattacaaggtcgctacatctattgggcggcaggcgtggctggtggggccattgtgggcttcatcgccgcctactgtcttatgggctttgtggccggactggtcgtattggcaactgtcttatctgcgggaatcgtgcttatcatcctcaaacagcgaaaggggctgcacagtaaaaatgtaaaacgtggagtgtatgtgtatgcctattcgcata
